United States Patent 7,745,391 (HUMAN THROMBOSPONDIN POLYPEPTIDE) - sequence listing, part 183

SEQ ID NO: 446817 - DNA, 2261 bp, Homo sapiens
cagcaggtttgagcagagcagctggtgaatcccagacgtggccccagctctgcctggctctctagcacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446818 - DNA, 1591 bp, Homo sapiens
ctaagtgttactgtttgggattgacaactggaattttgttaagtcctaacttcagtccactgttggatctctaaattccctaactcaggcctgctttacagagcccttgtgagagggtgctaaggagcctaagacaacagcaagcttcttttatgctttccaccccccaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446819 - DNA, 5546 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtaagtgctcctttttgcctcattcttccttcagaccatggcagaatgcagggtcagctgctggaaaaatggagcttaatatgtggcagtggcccttctgtcctgctataaagtcggggtcctgcccaagcccacaggtgatattcagggacagctcactgtatccctcctcccccatcccctacagactctagtgcgggtagatagcaaggccagaattagctgagtgtggtggcgggcgcctgtaataccagctactggggaggctgaggtgggagaatcgcttgaacccaggaaggcggaggttgcagtgagccgaaattgcaccattgcactccagcctgggcaacaagagtgaaacttggtctccag

SEQ ID NO: 446820 - DNA, 1381 bp, Homo sapiens
gtttttattatcttggtttttttttttaatatagaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446821 - DNA, 5528 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggtaatgaaagaagcagagtttgtagagatttttttgtgccttggggcaataatactctgttatgttagtagttaccaagacattacttggtacttttccagtgtctctaaagtcagaaatttcattcctacaaaattggttactcttgccactgacttttctgtttgttcatttgtttttgaataaacttatttggaatattttagatgatttacagaaaatttgcgaagtacaaagtactgctagtacagagagttcctgtatacccctcatccagctttccctattgttgacatctggtgttagtatgggacgtttgtcaaaactaaaaatccaaccttggtgtattactattcacaaaactttagactttatttggatttcactagcttttccatcatgtcctttttctcttccagcatccaacattgcatttagtcatcacataccctttggtctcctctgatttgtggcaatttctcagtcttttgtttttcatgaccttgacagttttggggagtcctggtcaggtattttgtggaatgtccctccatttggatttgtctaatattttctcattagactggagttatgggatattttaaaaataatgccacatagatgggtgggtgtggtagctcatgcctgtaattccagcactttgggaggccaaagcagggggatcacttgaggtcaggagtttgagaccaggctgaaacatagtgagaccctgtctctcaaaaaaaaaaaaaaaaaaaaaaa

SEQ ID NO: 446822 - DNA, 3142 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtgagtgaataaaaagtaatgatatttaaggcagaatttctgagatatcattctctacacaagtgatattttagatctgaggagttgggtctggctggtaaggttgatttttgttttagggaaaatagggttatgaagtctggttctgtgattttactactaggagatgaggggtaaagagaggaaggaaagaaagggtggagggaagtaagaaagaaaga

SEQ ID NO: 446823 - DNA, 2345 bp, Homo sapiens
  misc_feature (2304)..(2304): n is a, c, g, or t
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccgacgatggttggcaagcggaccatggtctagcggtagcatcagtgtcaaggaagaacacccgctacttagcagacctgcaaagggagtctccctttccctgggggagtntggagaagactctactcctccacctcttgtggagggcctga

SEQ ID NO: 446824 - DNA, 1754 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagcccaggagttcgagacctgcctgggcaatatagcgagaccccgttctccagaaaaagga

SEQ ID NO: 446825 - DNA, 438 bp, Homo sapiens
aatgtttgtatgtttatacttactagttttacttatttttatttctttttgttattttttgcaaatactagtagagcagagtgaaggtttaggtgtgatactaactaaattctgtttctctttcctttctctccttggttttgtttttattcagagcctgcaactggtgaaagaaaaaatggatctactgctgttgctgagtctgttgccaggtaaccaaagctggatgctatttagagtttaatacacagctactggtgatgagggtagatggtttatcaacaaaggaaaaaagttaaatgagaaagttaaaatgagactctttcataaaggatttagcaatgttttgaatggatcatagactttttagttaatacttttttaagttcagtgaagcttttttctacacctagaactaagataattgaaatgtcttta

SEQ ID NO: 446826 - DNA, 6800 bp, Homo sapiens
tgtcactgcctgcctgggtcctgcccgaggtctccatcctcggtttccctgtccttgccccgggccctgggagtgctctggaaggctgcgcagtattggaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactgggatttcttcatctgtttttttgagcttaatctcagaacaaatgacaagacatagtactttctctgagtctttcaacaggcttattcacttacggaggacagctcaccaaggaaattgaaaagttaagagtgaactttattctgtggcatcattcccaaaaggttattccagggtgtctaaaatgctatgcttgcagaaactcagtttaaggtaggtgaaggcccagattaacagttgtgccaaaagttgagtggaattgggcacagctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgc

SEQ ID NO: 446827 - DNA, 622 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttgaaaaaaaaaaattgtgtggggcgcgggccggggcccccggagaagggtttttttaagacaccaactgtggtgtggggcggcgcggacccccaagagtagaggttacggtgaggcaagcgtggcgacacaaagtgtgctcccccaagagggaacaagcccggggcaagagaaagaggggccggggagtatctccacacccaacataagaaaaggccccggggggacacccggaggtgtttgggaacaacactacgaagacgggaggttcagcgagcacacgaacggctcctcacagaggggggccccaggacaggcccgaaatcaaattagccgcgcggggtagcg

SEQ ID NO: 446828 - DNA, 6187 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446829 - DNA, 8488 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggtaagtatttgaagcccatccagaattgtataggcaggaggacagcaagctttggagggaagagaatctaggtgagagagtaaagctttctagaaattggaatgtctgtgggataaatttgagtgggtttgaaatgacttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctggagtacagtggcgcagtgacgacttactgcagcctcaacctcccaggctgaagtgatccccctacctcagcctcccaagctgctgggactacaggcactcgccaccacacccagctaatttttttgttgtcttttgtagagatggggtctcaccacattgcccaggctggtctcgaactcccaggcccaagagatccaaccacgacagcctcccaaagtgctgggattacaggcttgagacactatgtctgatggggcatttatttttgaaagcattcagatgtacatgagtccctttgcagaaaggcagtttgttggatattacttgtcatgctaaggtcctttcctgtctccttcataggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaaggtacctgaaagagtgtgtgtagtgtctttgttccagggatctccttagacctgtaggtgttaggccttgtggtccaaggctcaggcctaataggttgaccgtatccatgtttcttagagaagaaaagtaccaccttcaagaggtgagtcaacataagtgaagcactggacgtatatttgttaaatatttctacaaggtcagcacatagtgattataactctgcctttggtcatgatcagtagcagtgtgtttgacataatagggctttggtttgtgcagagtgggatgtattggttagaatcaaatctctctttctaatggagggctaagttgagtgtcctttccttcttcactttcccttgctccttgcagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactgggatttcttcatctgtttttttgagcttaatctcagaacaaatgacaagacatagtactttctctgagtctttcaacaggcttattcacttacggaggacagctcaccaaggaaattgaaaagttaagagtgaactttattctgtggcatcattcccaaaaggttattccagggtgtctaaaatgctatgcttgcagaaactcagtttaaggtaggtgaaggcccagattaacagttgtgccaaaagttgagtggaattgggcacagctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgc

SEQ ID NO: 446830 - DNA, 7917 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggtaagtatttgaagcccatccagaattgtataggcaggaggacagcaagctttggagggaagagaatctaggtgagagagtaaagctttctagaaattggaatgtctgtgggataaatttgagtgggtttgaaatgacttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctggagtacagtggcgcagtgacgacttactgcagcctcaacctcccaggctgaagtgatccccctacctcagcctcccaagctgctgggactacaggcactcgccaccacacccagctaatttttttgttgtcttttgtagagatggggtctcaccacattgcccaggctggtctcgaactcccaggcccaagagatccaaccacgacagcctcccaaagtgctgggattacaggcttgagacactatgtctgatggggcatttatttttgaaagcattcagatgtacatgagtccctttgcagaaaggcagtttgttggatattacttgtcatgctaaggtcctttcctgtctccttcataggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaaggtacctgaaagagtgtgtgtagtgtctttgttccagggatctccttagacctgtaggtgttaggccttgtggtccaaggctcaggcctaataggttgaccgtatccatgtttcttagagaagaaaagtaccaccttcaagaggtgagtcaacataagtgaagcactggacgtatatttgttaaatatttctacaaggtcagcacatagtgattataactctgcctttggtcatgatcagtagcagtgtgtttgacataatagggctttggtttgtgcagagtgggatgtattggttagaatcaaatctctctttctaatggagggctaagttgagtgtcctttccttcttcactttcccttgctccttgcagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446831 - DNA, 7219 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccaggtgaggagtttctttgtgtaacctaatatagtggcaatgataagagccaacttgctgtgttgagaagaggcctgggaggggttggggaacctggataaagtagccagagatttcaggaactgagaaactgccaaaatgtttttgcatgaaatagaatttttgttgtgtatagggaagagaaggtaggaccttgggttagttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggtaagtatttgaagcccatccagaattgtataggcaggaggacagcaagctttggagggaagagaatctaggtgagagagtaaagctttctagaaattggaatgtctgtgggataaatttgagtgggtttgaaatgacttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctggagtacagtggcgcagtgacgacttactgcagcctcaacctcccaggctgaagtgatccccctacctcagcctcccaagctgctgggactacaggcactcgccaccacacccagctaatttttttgttgtcttttgtagagatggggtctcaccacattgcccaggctggtctcgaactcccaggcccaagagatccaaccacgacagcctcccaaagtgctgggattacaggcttgagacactatgtctgatggggcatttatttttgaaagcattcagatgtacatgagtccctttgcagaaaggcagtttgttggatattacttgtcatgctaaggtcctttcctgtctccttcataggcaaccccgtgaaaatcctttccagaatctgaaggtactcttggtatcagaccaacagcagaacttcctggagctctggtctgagatcctcatgactggtggtagcatggcctctcggagcagttcgttgggttctgactgattactgcacgcagaggtatgttctcagggaccct

SEQ ID NO: 446832 - DNA, 2326 bp, Homo sapiens
gctttttgttattctttgcaggtgtccagagcctaaagtagaggagaaggcatagcagaaattgggtgtgctgtttttgcagcagcagtaggaagctttgtcagagggaatagacttacatgaaggagaatgtcctttacttgttatcccacgctccccactccctgcatgagattttggtggtgggtgtgtgaaccagcttcctgctgccccaaaggctcagcacatgtaggcctgtcatgtagtctgagggccaaggggagactttgtgaagaaaagattcagtagcaggtgctatcagactaacttgtcttcattctctagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446833 - DNA, 5504 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttccctatacatatggagacagtttctcttatggccaacaagagcttttctgacccttcataaaaccaaaataaatcccattttcttaaaggatagagaggaccctattgacagaaatagctgaagggacgtgtgtcaccacactggtgagtagaggcagaaatttttctaaaaaagatactttcttgggaaatatggctagag

SEQ ID NO: 446834 - DNA, 1149 bp, Homo sapiens
tttctggctcagataagttcatcaggacagtgcctgcccatcaggtcatgcttggtgctggggccttttggtgttaaggcttttgctgaggcaatggtgtgtatccctctagtaactgtgcccctgtccttcccaggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagta

SEQ ID NO: 446835 - DNA, 4266 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgaggtgcagacagggtctccagagagagagagccacagcaggggcagggactgcttcagtttctgtcgacgcggccgcgaattt

SEQ ID NO: 446836 - DNA, 2467 bp, Homo sapiens
acagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgccaaccatcgtgacgatggttgcaacggtgttgatgaatagtcctacatttt

SEQ ID NO: 446837 - DNA, 399 bp, Homo sapiens
aggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgaggtgcagacagggtctccagagagagagagccacagcaggggcagggttgctgacattttaatatcacaggaaaaggggagtaatgggaaatcccccatcctccattaaagataaatcaactaccc

SEQ ID NO: 446838 - DNA, 2120 bp, Homo sapiens
ggcacgagggtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 446839 - DNA, 437 bp, Homo sapiens
ggcacgagggtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctgttcttcctcttggtggaaggcaaagtccagggagaggctgtccctaggcggggcgctggtggggctgggggacacaggttgcccgcctcgggggcaggagacttccagggtgagaaaaaggcagggtgccgggtggagggagtgcccgcctctgctccgtgtggacagtctagcccggagcgggtgggagcgtcgccctgcctggcgccg

SEQ ID NO: 446840 - DNA, 2587 bp, Homo sapiens
ggcacgagggtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaaaaaaaaaaaaaaaaaaaaaaaaaaaaaaaaaaaaaaaaaaaaaaaaaaaaaaaaaacctacggaacacctaaatataaggcaaatattcatgtattagtaaattaagcatttgatcttgcgtcaagagcaatggtcctggttcttaattggtgaacttgttattaggccctcatgacccttttgattaactgccctgcctagaatctgttgaaccgtcccacccaattagattacccacaacacctacttaccaggcactgggtctccgtgaatttgtcttaaaggacacactttcccacaattgctcacagcctagagtagcttggtaaacctggcgctgttcttgacataagagcgtatagagtgctctttttatgactgaatagtcttttaactaacccaggccctatactatgaaccccttttaaatcgcccatttcccaccttaagagctactcttctccac

SEQ ID NO: 446841 - DNA, 1365 bp, Homo sapiens
tcttacagcgagacactgagtgggaatccatctctagtcttcctcttcaattggctggctaatgagcctaagtccagggctggcaacctcactctctggtatgctctgacctagtgatgcatataacaagttgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 446842 - DNA, 269 bp, Homo sapiens
gcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggtccacttttgcctgttttatactttttat

SEQ ID NO: 446843 - DNA, 1696 bp, Homo sapiens
tggaggtgaggagatccggtttccagcactgccttgctccgaattgggagacgtttgtcacctgccttgttcgctgtggcctctattctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttct

SEQ ID NO: 446844 - DNA, 2476 bp, Homo sapiens
ggcacgagggtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaaaaaaaaaaaaaaaaaaaaaaaaaaaaaaaaaaaaaaaaaaaaaaaaaaaaaaaaaaaaaaaaaaagggggggggggtaaaaaaaagctccccccgagagggagcacccaagaagctggcgagcgacgacacgacactatagttggctggaacaacgaaaggcggcgccccaccaaatgggaggaggcagccataaatcaaaaacccaagaaacccggcgggcggcggctacatacaacaacgatccgttggagcgggcgaaaaaaaccgaggacccgtgggcggaccatctgcgcagcgagaacacctaccaccgggggggggaaacacatcgggggacgcacccaccaggaggct

SEQ ID NO: 446845 - DNA, 2678 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446846 - DNA, 847 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgccaccagggtctcactattttgcttaggctggtcttgaaggtctgggctcaagcgattctctcactttgtcctcccaaagtgttgggattacagattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagtgttgggggacaacaatgtgatcagaagtattcctggaagaagtacccggatggctgggacccgggacgaccgaataagtcta

SEQ ID NO: 446847 - DNA, 778 bp, Homo sapiens
gatggggtttcactatgttggccaggctggtctggaactcctgacctcgtgatccacctgcctcagcctcccaaagtgctgggattacaggcgtgagccactgcgcctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgccagtaggtggagtagcactgtcttcctggtcccggacctcagagggctttgcctgttagggtactcttatcactcagagatgggccttgagttttcagagaacagaaacccattaagctgtttcccctattgtattcatgtgccctttgtgtttctggcaataatttattttatatttcaactaaattttaaatttctaattcatgtatagttccttgtgtaatttgtactgtaccattcagcttattaaccattactccttgttttccaccatttgtaaattcagcatgtaatcagagctttcagaaaaaccatgtagaagactgggtgtggtggctcacacccataagccttgcactttgagaggctgaggcaggaggatcgtttgagcccaggagtttgagaccagcctgagcaacatggcaaaaccccatctctac

SEQ ID NO: 446848 - DNA, 3472 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcgcctcccaaagtgctgggattacaggcgtgagccactgcgcctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgccagtaggtggagtagcactgtcttcctggtcccggacctcagagggctttgcctgttagggtactcttatcactcagagatgggccttgagttttcagagaacagaaacccattaagctgtttcccctattgtattcatgtgccctttgtgtttctggcaataatttattttatatttcaactaaattttaaatttctaattcatgtatagttccttgtgtaatttgtactgtaccattcagcttattaaccattactccttgttttccaccatttgtaaattcagcatgtaatcagagctttcagaaaaaccatgtagaagactgggtgtggtggctcacacccataagccttgcactttgagaggctgaggcaggaggatcgtttgagcccaggagtttgagaccagcctgagcaacatggcaaaaccccatctctac

SEQ ID NO: 446849 - DNA, 2880 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcggtcgggcacggtggctcatgcctgtaatcccagcactttggaaggctgaggcaggtggatcacctgaggtcagtagttcaagaccaacctggtcaacatggtgaaaccccatctctacta

SEQ ID NO: 446850 - DNA, 2503 bp, Homo sapiens
  misc_feature (13)..(13): n is a, c, g, or t
  misc_feature (16)..(16): n is a, c, g, or t
tgactctgaggantcnctcgaatcgacggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446851 - DNA, 2540 bp, Homo sapiens
cagtttgagatctttctcttgtgccctagctggccaaaaaggataggaatttgaaggaaataatttctttaaaatctgcttatgtttggaaagagtcaaaccttactatctatatgacatataatcctgatatcagttttgtttacagttactatgtttttttcagaactgtttattatactgcaaagatcatgtggaaggctagttattttggtgacctttttttattttgttttgtagccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446852 - DNA, 2419 bp, Homo sapiens
  misc_feature (13)..(13): n is a, c, g, or t
  misc_feature (16)..(16): n is a, c, g, or t
tgactctgaggantcnctcgaatcgacggtttctcccacatcgacctggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446853 - DNA, 2453 bp, Homo sapiens
agcagggaacaatcacttagtaaggaagacaaataccaaaaacatcagcggggaacaatcacttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446854 - DNA, 2581 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446855 - DNA, 2485 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446856 - DNA, 1749 bp, Homo sapiens
ttctaatatatatatttttttctttaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446857 - DNA, 1344 bp, Homo sapiens
cttagatgacagtcggctgatggtttcgataataactagtatggggataaggggtgtaggtgtgccttgtggtaagaagtgcgcctgggtgcgctgaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446858 - DNA, 1040 bp, Homo sapiens
  misc_feature (28)..(28): n is a, c, g, or t
atggatttggtatctccccgaggagtanctttattgatcaacatccttcattgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446859 - DNA, 1048 bp, Homo sapiens
gattagaaaataaataggttcttatataaaacatttaaaacagtatggaaatacgtaatgtgtaaagtgaaaatgcagccattcttaagtctggtgtgtattagaagagtcagctttcaattatagaaaatacaggtgagcacaggtaactcccacgcttttacccattttctttttcccttttttctgaaataagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446860 - DNA, 1005 bp, Homo sapiens
  misc_feature (963)..(963): n is a, c, g, or t
  misc_feature (965)..(965): n is a, c, g, or t
  misc_feature (980)..(980): n is a, c, g, or t
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagnancgaagcatcaggtcnacatactgccgaacgtaacctctgg

SEQ ID NO: 446861 - DNA, 482 bp, Homo sapiens
ctagggacaaatgggtccagggtggccctttgattgtggtcccgggtgcggattggcagggcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagccacccttacgatagcacccgggatcctctagat

SEQ ID NO: 446862 - DNA, 430 bp, Homo sapiens
ttgtccagcaaccttctctttactgatgaatggaaccaggaaagggttgccattgtcagtgagtggaattgagattccggtgtatacaactgagtctccggtgcctttgtttaggctggagtgagttcctagaagctggtgattcttggtgttcttgtcagactcattactggaccagaggagctgatgatgagaccccaccccctacttaacccacctccatgctactgtgaggtcctagctgactggtctttccctcagcaacctcttgttctagtcgaaagtctatagtattataaacacgtgaaagtattgttctgaaagtaatgcttcaaaatagtcaatttgtggagaaacttgttaaattgtttaaattattggcaggatgacccatctgcaatggattttgtcacctctgctgcaaacctca

SEQ ID NO: 446863 - DNA, 482 bp, Homo sapiens
agggaacattattcctgctattgctactactaatgcagtaattgctgggttgatagtattggaaggattgaagattttatcaggaaaaatagaccagtgcagaacagtgagtatttctgtttgcatttttatgcaaccccccttaaaaaaatcattaattaaaagtacattaaacagataatttttaaaatgaaaacaataaaattggtttaaagcaatggaaaagtaatttttctggttaccaagtgagtgtgtgtttaagcttcctggaaattgcaacaaaaaggaaaaattaagaagttgcttttgcttttaacatttccaattttactgaattcttcgaagaattcattgtgcggtccttatactaagaagatgtttcaactgtttttcaattctgagagtgctatatgggttttaaaatttgcttggtcattttatagtcccctgttcagtcattctcctattgagtcattcttttc

SEQ ID NO: 446864 - DNA, 2683 bp, Homo sapiens
ctagggacaaatgggtccagggtggccctttgattgtggtcccgggtgcggattggcagggcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446865 - DNA, 2926 bp, Homo sapiens
  misc_feature (2857)..(2857): n is a, c, g, or t
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttaaaaaaaaaacaaaacaaaaaaaaaaaaaaaaaagaaaaaaagaaaaaaattgttggccgcttgggcccagtgaactttaaactctgaggaagtttatgcattgggccgaattttgggctactttggccaattcgcctttagggaggggaatacaaatacctgggccgggtttacaacgngggaatgggaaaacctggggttcccaaaataacgcttggagaaaatccccttttgcggtgggggaaaaa

SEQ ID NO: 446866 - DNA, 2772 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgccaccagggtctcactattttgcttaggctggtcttgaaggtctgggctcaagcgattctctcactttgtcctcccaaagtgttgggattacagattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446867 - DNA, 2488 bp, Homo sapiens
  misc_feature (25)..(26): n is a, c, g, or t
  misc_feature (37)..(37): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (53)..(54): n is a, c, g, or t
  misc_feature (62)..(62): n is a, c, g, or t
ctttttcctatgatgttaaaacccnngcaacctttgncggttngtnacntnannaaacctcngctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446868 - DNA, 2586 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446869 - DNA, 2304 bp, Homo sapiens
aaagataggctagtacgaggctgggtgttaatcggccgaggctaaaatcggaacgatacagagaagattagcatggcccctgcgcaaggatgacacgcaaattcgtgaagcgttccatatttttaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446870 - DNA, 2522 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446871 - DNA, 2139 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgtttcccttggtcacaaaggacataacaatctggttctgcccaaatgaactaaatagta

SEQ ID NO: 446872 - DNA, 1554 bp, Homo sapiens
ctagggacaaatgggtccagggtggccctttgattgtggtcccgggtgcggattggcagggcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacagatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtta

SEQ ID NO: 446873 - DNA, 1429 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctggcaaatggatttgtccacctctgtgaaacctcaaggatggctatttgcagtattgaatgtgacagaggtgcttgggtttcgatccatgggcgggaacattattccgggtatgggtgtagtatggcgcactgccggtggaatctcggacgggtgcagatgttcggagaagagaccgggagacattttgaatacaacaacgacaaaatcgtgctgtgagggcccacccagtgtttgtccacaggtgggagtaaggggcccagagggaatggcaggggagacaccaggagacagag

SEQ ID NO: 446874 - DNA, 1023 bp, Homo sapiens
accaggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggaaaggatttctgaatgctatcgagaccgtacaaaggttgccaggagtgtgtttacatcatagagat

SEQ ID NO: 446875 - DNA, 2164 bp, Homo sapiens
tttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446876 - DNA, 1052 bp, Homo sapiens
  misc_feature (7)..(8): n is a, c, g, or t
gcgcgannggggtttggggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgccttttaaaacaagggaaaaagtaatgaaccactaataaagcgatatcgccgtcggaggtacaggatcatgagttaccgcatccgtgctctccagctcactcatctcctgcgccgcgcgg

SEQ ID NO: 446877 - DNA, 225 bp, Homo sapiens
aggctgaggtgggtggatcaatcacctgaggtcaggagttcgagaccagcctgaccaacatggtgacacacatacgtacacacacacacacacagattgctttagtcacaaggtgattgcagcaattagaagtgctcattccggcatgggctggtgaggggcacagatggcagccactggactctctggaaatgtcccctcatttggagacaacccctgaagttc

SEQ ID NO: 446878 - DNA, 2214 bp, Homo sapiens
  misc_feature (1)..(1): n is a, c, g, or t
  misc_feature (26)..(26): n is a, c, g, or t
  misc_feature (48)..(49): n is a, c, g, or t
nattcggcactagggcgcgagcaagngttggggaggcggcgaccagcnngttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446879 - DNA, 2027 bp, Homo sapiens
  misc_feature (7)..(8): n is a, c, g, or t
gcgcgannggggtttggggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcagctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446880 - DNA, 2725 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtcaaaaacaaaaacagagaaagagaacaaaaacaaaaaagaaacacaaaaaagagagaacaaaagaaacaaacagaaaagagcgaagaaaaacacaagaagaaaaagagaaacagaagacgcaggggaggcgggacagcgagggcgcggcggggggggggggggaggaaagccaaggtgggagaggacggggagaccggagcgggcgcaagacggacaacgaggacgaagacgacgcgcgccacgaggagaaagaggagagcacgagagagagcagcgtgggcggacggaacaacccccggagggaagaacaagcccgcgcgcgaggaagcaaccagccgcgggcgggggacgagagacggcacgacgacgaggagagagcacgcagcaggcgccagggcgagccccacgctcaaggggggggctcagccaagaggcgggcgacatgagagcaaggagaccccgagcgggagggaggtggcccggcgcaggggg

SEQ ID NO: 446881 - DNA, 3084 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggtgaagtgggaaagggagggctggggtgacgggtgggtgctggcctggccacgtcctcatagccctgtctgctgcaggagcgggaagacgagcttcgagccatggcccgcaagatccgcatgaagtaagaccttgcccctccctgtcccatggccacacctcctggcctgcctggccttcccaccatgggctgctggctcaagccctgcccagctccctgtgggtggatgaaaggcagagatccctgcctggccctcggggctgtgcccagctgcctctcttgctcctctccctgaatttcctcccaccatttcgacctgcctcccgccaccgcgacctcctcccagctcttccagcctccaagtgccagtcacctttgctgtttttttggcctggcaagctgttcctgataccccttccccactcacccaccgccatgggtctttctcctgtcccagcctcagtttgcttatctcctaaatggagatacagtcactgtcccacctcacaggctgttgggaggatttgacaagatcaaggccaggcacggaggaggcacccagtagacgtagccattgggttgccaagcctggccactgtgacggagaccatttcaacactcactgtgtgcaggtgccccagtgcggcaggaaatgatgggactatcctgcctccctctgttccccaggctttcctaggaaggggctgggattccagtcagccccgccagctggggtccctctgaacctggggctccctttccaagcggggattggtggcagtaccggcccccttggtttactgtcttcctcggagtagggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446882 - DNA, 804 bp, Homo sapiens
ggatccggacccagggtggggtgcggttggggtccctggagcctcacagtcctcctcccgccctgctgcatccccaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446883 - DNA, 2312 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446884 - DNA, 1988 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccggtcggtaacgctcacgccgcccgccctacgccccggtcaccatggggggtacccggggcagaggggggccgcggctcaggcctgcgctgaccggccctccgtgccccgcctgcagccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcagtaagaatttggaactcgcccgtctaattcccgtcagcagcagtgcccaagagctgggcccggt

SEQ ID NO: 446885 - DNA, 1257 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcacagtggggggtggggaggacaagggggtgggtaaggggctcaagctgtgatgctgctggttttatctctagtgaaataaagtcaaaagttatttaattcccgtca

SEQ ID NO: 446886 - DNA, 1086 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgccttttaaaacaagggaaaaagtaatgaaccactaataaagcgatatcgccgtcggaggtacaggatcatgagttaccgcatccgtgctctccagctcactcatctcctgcgccgcgcgg

SEQ ID NO: 446887 - DNA, 882 bp, Homo sapiens
ggatccggacccagggtggggtgcggttggggtccctggagcctcacagtcctcctcccgccctgctgcatccccaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446888 - DNA, 1805 bp, Homo sapiens
tttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttcttttcccagcctacctgtcaccttcctaggagccgttcctatttggtaccgccctgagcctgagggggatgcctcatttcccttcctgctggcttggggggggatccactccttctctctgatttcaaggtctcgcccttccctaaagctctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgatcggtggggtcccctctctgccctccccacctgcagtccctgggcatcgtttctgtgtctcgtccctcaccctctgtggggcaccccgtgcttacgaaccgtgtctctctccctaccccgccccagggcacaccagcctcctgctgcccctgtctcactcctgtcctcctccgttccggccttcctctgcctcactcatctctcatttctagggtgctatttctatgatcttttcccctcctaggtgttggctccattctcctccacttgggccggcctctctctgcctttgcccct

SEQ ID NO: 446889 - DNA, 273 bp, Homo sapiens
cgaggcatgatggtcgactacaagaagagggcggagcggagacgggagtattatgaaaagatcgtgagtaactggccttttgtctggggtgagggaccctgggttggggggcacagctggtcatcctggtaaaatctgggcttggaagtatgtcaagacaagaggctcatttcctcaggagtatattcattaatcttttcttgaggataatcattggtgggatcccaagggcttctgtttgttgtagcatactgtgtcgtttggtgtggcctc

SEQ ID NO: 446890 - DNA, 183 bp, Homo sapiens
ttgctcccctcccacttcaggatgccctggcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttctttt

SEQ ID NO: 446891 - DNA, 495 bp, Homo sapiens
acctgaggtcaggagttcgagaccagcctgaccaacatggtgacacacatacgtacacacacacacacacagattgctttagtcacaaggtgattgcagcaattagaagtgctcattccggcatgggctggtgaggggcacagatggcagccactggactctctggaaatgtcccctcatttggagacaacccctgaagttcagttttgaggacctcaccccaggtcaaggaagaggccctggccctggatgtttgctcgctcttcacctgttgttttctttccaggtcgagaatacagctcttctcgaaggtaaggaagcccatgaccctccactttcttggaagtaacacttgtcctttgatgggaggtcctggctgtcattcctccagcctcaccctgtacccacctccagttggaggggctggtctcatcccttggggaacatccttccctccacagacaagtgccccgatcactgaagcatccacggccc

SEQ ID NO: 446892 - DNA, 2234 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446893 - DNA, 486 bp, Homo sapiens
  misc_feature (23)..(23): n is a, c, g, or t
  misc_feature (28)..(28): n is a, c, g, or t
tcccgcctcttctcccccctccncagcncaagctgacgcctcaggagaagctgaaactgaggatgcagaaggcgctgaacaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcacagggggtgggtaaggggctcaagctgtgatgctgctggttttatctctagtgaaataaagtcaaaagttatttaattcccgtca

SEQ ID NO: 446894 - DNA, 3030 bp, Homo sapiens
tttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttcttttcccagcctacctgtcaccttcctaggagccgttcctatttggtaccgccctgagcctgagggggatgcctcatttcccttcctgctggcttggggggggatccactccttctctctgatttcaaggtctcgcccttccctaaagctctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446895 - DNA, 1595 bp, Homo sapiens
ccttgttggccaggctggtctcaaactcctggtctcaagtgatcggcctgcctcggcctcccacagtgctgggattacaggtgtgagccaccgcgcccggcctgctcatccatttttcatagccacataaaatcagagcagttgtgtgtcattgtccttcctggttatttagcgaaggctgcatggttgtgagtcaagtccttgtccagagctgggtctccactgccctccaggctccatccacccgcctggtttcccgggtcgctgtggcccgcgctggcgctgctgttgatctgctgtgtgtgctgttcccgaagaggctccgggagcctgagctagtgagcctcctcctccctacccgcaggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446896 - DNA, 2311 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggtgaagtgggaaagggagggctggggtgacgggtgggtgctggcctggccacgtcctcatagccctgtctgctgcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446897 - DNA, 1838 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccggtcggtaacgctcacgccgcccgccctacgccccggtcaccatggggggtacccggggcagaggggggccgcggctcaggcctgcgctgaccggccctccgtgccccgcctgcagccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccctgtgatgctgctggttttatctctagtgaaataaagtcaaaagttatttaattcccgtca

SEQ ID NO: 446898 - DNA, 1966 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccggtcggtaacgctcacgccgcccgccctacgccccggtcaccatggggggtacccggggcagaggggggccgcggctcaggcctgcgctgaccggccctccgtgccccgcctgcagccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446899 - DNA, 1051 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgatcacgttcatcaccagttttgggggcagcgatgaggaggcagccgcagccgctgctgccgcagcagcatcaggagtcacagggggtgggtaaggggctcaagctgtgatgctgctggttttatctctagtgaaataaagtcaaaagttatttaattcccgtca

SEQ ID NO: 446900 - DNA, 585 bp, Homo sapiens
ggagatccagccccagggacagggaggggaggggaagggtctgcccctgtgagaaccatgtccctctcccctcctcactgtacactggggctccacctgtcactgaaccttctgggacacccaccccctctcccgcctcttctcccccctccccagcccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 446901 - DNA, 1009 bp, Homo sapiens
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgatcggtggggtcccctctctgccctccccacctgcagtccctgggcatcgtttctgtgtctcgtccctcaccctctgtggggcaccccgtgcttacgaaccgtgtctctctccctaccccgccccagggcacaccagcctcctgctgcccctgtctcactcctgtcctcctccgttccggccttcctctgcctcactcatctctcatttctagggtgctatttctatgatcttttcccctcctaggtgttggctccattctcctccacttgggccggcctctctctgcctttgcccct

SEQ ID NO: 446902 - DNA, 5085 bp, Homo sapiens
  misc_feature (1771)..(1771): n is a, c, g, or t
gttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcaggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgancattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446903 - DNA, 4991 bp, Homo sapiens
gttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggtaggtgtttgggtgctcgcggctgcggcgggcgggctgggggcagcggtggccgtgcattgccgcgctgcgaggacggcgctgggttcgcggccgcgaggagggtgtgcctttgccgcgccgcctacgtgcgggtccgggctccgcggggccgggtgcgggaccccgcagatcgtcacccgcaacccaggcagccccaccgcgagtgccgccggaccccctggacgccgctgccagaggcgttcgcgcctatctggtatgaggtccacagacccgattcttacaacctggcgctctaacctcgccaacgggccaggaaaaaaacagaacaaggaaaagaagaaaaagtctgttccaagtaataatgggactagacagtaactgtttgcactttcgtctcttatggaaaatatgattattttgatgctttagtattacagactgtatcagacatactcttaaaagtatttaaaaacgtggggtcctaaaaatttcctagatcgggacagctgataatgcgacttctgttagtctccgcatccaactttcagggcggaatggggatttctaccttttactgaatatactcctgtaattttgaatattttttctcatcaaatgtgttactttcatgttttaggaaaccaataaaaatcaaaaatagaaacacccagcttaggtcctccttcttccaggaatcctcctctaacccctccctcccaggcaggatcggaggcccctcccgggtgctttctggggcctcactgaggtcctggtcccctaagtcctcccccgcagcccctccgcgtattaacccaccggtctcgctgggctcagagattgcttacttagcacatggtaagtgattaatactgtttaatgaccgagggaaaagataaaatgttctctgatgtttcacgcttttcgctctgaagttaaatagtggtaaatttatatgcgcttagataagaacatttaacagttaaggatctggaaaagttgacgacgtccgatgtccgtgtttcctgatccagcagttgcacgcctgggtattcatccttaagaacaatgtttttcagaatttgaagtccattttagtgggtcgtaaagtcatttaaatggatgatcagaatttgtaaaacacagacggagaatagaacatcagtgtctctcaggtcataggggtgttcgctttatgaatctctctccccctcctcagtttcatacatacacaaatgtgtgtcatgatgtaaaacgtcattccttagtatgagtcatggacaaaaaagtttgaaagccactgccctagataaattttaatacatgtccacaagcagacgtgtacaagaaggttgactgtaatggcagaaaactggatgccgccttcatgcctacctgaaggagaaagataaattatacaccactcataaaaagggcacactgtacagtggccaatgaagtatttttgtgtttcaacacaaatgcctttcagtgttgaaccaaaaaaaaaaaaagttgccggagaatgctgtgtgatatcttctatgtaaaattcagaacctggtggagcaaagctgttgtttagggatgcatgtataggcattaaaagtagtaaagaaaaaaagtcaagctaatggtcatctcctagtggggaggagagggtcaggggctcagagatgctggaaatgctttatcgcctgacctgtgcaatggttacatgggtgtttgctttgtaactctttgttaaatgatacacactgggtttgaatgttacatttccccccaaatatgttaaaatatgggtgttgcaaactgaagaagcctgagtctagggctctccgtctgttattcttatttcctggcttctttttagaaaaaaaaaatcttgctcagggaggagtacctagggaatttatcagtaatgttttatttcataaattccatggtggacataccagtattcattaaattattctttatgtattcttataacttaatttataatatttcaaaaagcatttaggagaaaacatcatttggtgtgtttgctttcccaaaagtcacatttacatgttttgtacacaactggaatattttatatagtaattttagctaaaatcaaattttgttatgaaaaacgaaatactaaaaagtatataaaaatcacagaactttacagactttcagcgttttaaaatgctaacatattgtatttacctcaataatttctgttcctcagttctttcaggccacatttttagtgctcaatagcctcatatgactttaatattttattatattttattatgttatatattttacattatacattatagaacagaatatttccatcattgcagaaatttatattggaaaacattctggatacaaatatttgttatatacttgcagatattaaactgtagacattaatccttatgctttttgtcttaagatactctactattaatgaaatgtattctgaatatttttctaagaatttttaagtttatgttttgtccacattttgttctttaatttacctgagacatgtatatattgagatgtatatattttatgttatgagatcaagcttaattaattttcagattcccacatgaaaaggtaattgtcccaatatcagtgattagcagtgccacttctgtcacatacagtacccagatatgtttgggcttatttccaggctgttaatcctggtttatttgtcatttgaaaatactgcagattttcatttactgctgctttctatgtagtatattgttcagttctaagaatttaagattttttcattgtgatattttttcttcccctaagagatttgtagaaagtagtctagttccaatgtggaaggttttgtgagttatccttttgttactgatttctaatttgcactgtagttagcatacgtgtcaaggccaacaattctttgaaattcgagaattgctttatggttttaactgctccttgtatcatcaagaataatttgtactcacagacttttgaggcaatgtatgtaggtgtgtgtatatatataatatatacacatacactttatatatagattatatataatctctctgtagagtttatataaaaattaaatatatttatataaatgtatatatatatatgaataaaatctcctgtctctaaggtttatgtttcattaattcaggaaagttttgtcttttatctctttattttcacacatttttgtcctattctttaggagctatgattagacttctgttagacttcctcactctatcacccacatcttttaaggtagatttaatgtatttaatatattttttatccatgttgaattctacatatgttttttagttctataatttatgtacaacaaaaaaaagtgtgtagcttggtgaaatttacatatgtgtatacctttgtgattactacccagataaacatataaaacattttcattccttctgccccttcctatcaatggagccactcgcttcccccagtcaactactgtcccgatttctatgaccatgtattattttcaaatgtttttaaacttcatataaacggagtcatacagtttattcttttgttcacattgtattcatccatgttgcatgtataagaatttttgtttgttttttatttttgctttgtatcaagggttggcaaactatggcctgtgggccaattccaacccactgcatgtttctgtttataaaattttattgggctgtgttcacccaccactatgcctggataattttttgtatttttagtacagacggggtttcaccgcgttggccaggatggtcttgatctcctgacctcgtgatccacccgccttggcctcccaaagtgctgggattacaggtgtgagccaccgcgcccagcccactctcaagattttgaagacatttgcctttgttttcctccagaaactttatagttttagctgttggatctgtgattatcaccagttgatttttgtgtatggtgtgagggggggatcaagatttattttgtatatggacatccatctactctacacatttattgaaaaaaacaacacctttcttttcccattgaattgcgtggggactttgttaataaatgaatggtcatatatttgggtctgtttctggactctgttctttccacttggactaattatccattcttgcatcagtaccatacttttttaattactgtagtttatggtaagtcttgacatggtattgtaaaccctccagttttgttcttttaaacaaatgttttgactatttaagtgctttacatttccatataaattttcaaatgtgcttgtcaatgtccatt

SEQ ID NO: 446904 - DNA, 601 bp, Homo sapiens
gcggccgcccggacccgccggccggagctgacccagtgggccacgggctccggactccagaactttccaagcgggggaaacttggcggcgggattgctgtcacgtctaatgtggctgctgcctcgtgtcacatctgaaactcatctgtacctcacttagaaaggtaaatacgtctatgcggaaccctccaactcctgccccccagtgctcctgccatcagtcatggctctgtattcttattctctcctcgcattacagcacaaaccagagccttcgcctcctccatggtagaggggcttatgtcccagaaaagactttgtgagagaatttacatttgaggaacttcaggccttgagggggaaaataaggttgggggattaagatgtggacttaatgaaagcctgtttttcactctaaaaattcaagaggacacgctaagaacgatcattgctatttatctgtcttaaattagaaatcatgggcattgtacagttgatttttacttatcatgacttgctcactagaaacttcgtgatctctttctgttatattttaaaaagatgtttttaaatggttttatcttaaagaaatattaggaaaa

SEQ ID NO: 446905 - DNA, 663 bp, Homo sapiens
gcggccgcccggacccgccggccggagctgacccagtgggccacgggctccggactccagaactttccaagcgggggaaacttggcggcggtaatttttatttttgtttgcagattgttcctgcctgattcataaacatcgtgattggcttttgattgctgtcacgtctaatgtggctgctgcctcgtgtcacatctgaaactcatctgtacctcacttagaaaggtaaatacgtctatgcggaaccctccaactcctgccccccagtgctcctgccatcagtcatggctctgtattcttattctctcctcgcattacagcacaaaccagagccttcgcctcctccatggtagaggggcttatgtcccagaaaagactttgtgagagaatttacatttgaggaacttcaggccttgagggggaaaataaggttgggggattaagatgtggacttaatgaaagcctgtttttcactctaaaaattcaagaggacacgctaagaacgatcattgctatttatctgtcttaaattagaaatcatgggcattgtacagttgatttttacttatcatgacttgctcactagaaacttcgtgatctctttctgttatattttaaaaagatgtttttaaatggttttatcttaaagaaatattaggaaaa

SEQ ID NO: 446906 - DNA, 4462 bp, Homo sapiens
  misc_feature (1624)..(1624): n is a, c, g, or t
attttgtaatttctgcttgaggctgtatttttacttggggtctctgaaaaataaatacaaatacatgaatactccctgcttaccagacagtgtcaagcatttatctcaaattagtttatttaattctcaaaagggtcttgtgatgtgggtgtaatcgttatctccattttacaggacaggaagctgaggtagagagagaaaaccaattgcatgaggtctctaagtggctccaggtggcaccaagattggaatctaagctttctggcaccatactgtggtcttaaccacatcactgtatagcctctctaaaactaaagatcccttaaggactcaaatgggtgcctctggaatgctgggatatggcattatagcatagcatgtcgatggagagagatttttgacccctggtatccttgaactcatattctgattaggtaaatgtcagcattcatagtaccaatgtgttttttcttgatgctttttttttttttaaacttttgatattgtttttcctttaggattgctgtcacgtctaatgtggctgctgcctcgtgtcacatctgaaactcatctgtacctcacttagaaaggttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgancattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446907 - DNA, 3822 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446908 - DNA, 3245 bp, Homo sapiens
gttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcaggattgctgtcacgtctaatgtggctgctgcctcgtgtcacatctgaaactcatctgtacctcacttagaaaggttgcagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446909 - DNA, 3378 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacaga

SEQ ID NO: 446910 - DNA, 4436 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaaaaaaaaaaaaaaaaaaaaaaaaaaaaaaaaaaaaaaaaaaaaaaaaaaaaaaaaaaaaaaaaaaaaaaaaaaaaaaaatgaccaaagataaacaaataaaaacattggcaaaaaccaagacgtctcccattattaaaccttatgaagcttgatctcccatttccccttttgcgggctgtcataaaaaggcccgaggccgaaacctttcgcaattgtaagcaattctcaatgctgaatgcaaattgaaattgttaagctttggataaaatttgaattaccgttcgattctttctgatcatcttttaacctatagcccatagtccggaaaagtccattatcctttataggtaataacaccttaacggatttagggttgtatcgagttagaaacctgaattccacttgttaattatcgagggaacttcgacgtctaaaggtcaaagatccgaatattatggtcaagtccaactccctatacccttaaccctttccctatattaatgtggttcagacgtcctatatgcgtcttaaaatctgaaacctttaaagcgaagacggccgccttaaaaatttacacgttgaagctccattaacacttggtcctgaatcgagtg

SEQ ID NO: 446911 - DNA, 1227 bp, Homo sapiens
aactctgaactttttattggcctcctgctccccaaagggtaccctgcttctgctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446912 - DNA, 1059 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggtggacccaggtacatgccccagcccacgtgcttcagcagtcctcgggctaccgtagctcgcaacttcg

SEQ ID NO: 446913 - DNA, 404 bp, Homo sapiens
tatcaatggagccactcgcttcccccagtcaactactgtcccgatttctatgaccatgtattattttcaaatgtttttaaacttcatataaacggagtcatacagtttattcttttgttcacattgtattcatccatgttgcatgtataagaatttttgtttgttttttatttttgctttgtatcaagggttggcaaactatggcctgtgggccaattccaacccactgcatgtttctgtttataaaattttattgggctgtgttccatggctcctgtctataattccagccagtcaagaggctgaggcaggagaatctcttgagctcaggagttcgagcttacagtgaactacgatcatgccactgcactgcagcctgggtgacagtgagatgaccccatctt

SEQ ID NO: 446914 - DNA, 3998 bp, Homo sapiens
gttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagattgttcctgcctgattcataaacatcgtgattggcttttgattgctgtcacgtctaatgtggctgctgcctcgtgtcacatctgaaactcatctgtacctcacttagaaagtttctttctataacacaagcctgaacatattgctctcctgattaacaactttcagtggttctgattagacaagacttttcgttgcagtcgacagaaacctaatgggaccattgaagaattccaaacagggtctttataagcttcttctgaaggtctcagacattcagccacggaactcaagtggaatttgtttggataacgtgactgatttcaaagcccggaccccttagacgtgcccatttggtgctgcaagtatttgcataggaatcagaggagttaatcttcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446915 - DNA, 4542 bp, Homo sapiens
  misc_feature (1704)..(1704): n is a, c, g, or t
attttgtaatttctgcttgaggctgtatttttacttggggtctctgaaaaataaatacaaatacatgaatactccctgcttaccagacagtgtcaagcatttatctcaaattagtttatttaattctcaaaagggtcttgtgatgtgggtgtaatcgttatctccattttacaggacaggaagctgaggtagagagagaaaaccaattgcatgaggtctctaagtggctccaggtggcaccaagattggaatctaagctttctggcaccatactgtggtcttaaccacatcactgtatagcctctctaaaactaaagatcccttaaggactcaaatgggtgcctctggaatgctgggatatggcattatagcatagcatgtcgatggagagagatttttgacccctggtatccttgaactcatattctgattaggtaaatgtcagcattcatagtaccaatgtgttttttcttgatgctttttttttttttaaacttttgatattgtttttcctttaggattgctgtcacgtctaatgtggctgctgcctcgtgtcacatctgaaactcatctgtacctcacttagaaagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgancattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446916 - DNA, 4459 bp, Homo sapiens
  misc_feature (1621)..(1621): n is a, c, g, or t
gttaaatattaaaattagaaaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgancattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446917 - DNA, 3768 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446918 - DNA, 4148 bp, Homo sapiens
  misc_feature (30)..(30): n is a, c, g, or t
cggcattttgggacaactgtttttaacgtnaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaatttggcttgattaatttttcatacagctccacctgtgtcaacaacatgaactacatacactcagatcaagacagaaaacacttccggctccacctggctccctcatgccccctcctggtcattacttcccccacagaaaccactgttttgacctctactgagcatctattagaaacttcactttttttgagtaaaataattatgacttaagatggaagcttgtatgcgtccattaaattcacagcactaagagcttattatttctaaaaatgcaatatttaaatcattctataatgtgacataatttatttctaatgtatagatca

SEQ ID NO: 446919 - DNA, 1746 bp, Homo sapiens
ggtgactctaaggatccctcataggttcgcaggacaactactccgtcagcaagaaccaagccacatcaaacctgcctgtccacaccacttacttccctgttcacctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 446920 - DNA, 1970 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446921 - DNA, 1935 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446922 - DNA, 1813 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446923 - DNA, 1881 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggtactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446924 - DNA, 1338 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446925 - DNA, 2003 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446926 - DNA, 1835 bp, Homo sapiens
atatttgaaatttactctctgaacattgaacatcaaaggaaggagaataaatttggatatgaagagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446927 - DNA, 1846 bp, Homo sapiens
cgcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgaaaaaaaa

SEQ ID NO: 446928 - DNA, 450 bp, Homo sapiens
cagattgaccccaacaccaagaagaactggatgcctgcgagcaagcaggcggtcaccgtttcctacttctatgatgtcacaaggaacagctatcggatcatcagtgtggacggagccaaggtaccaccccctcagctgattttaatactcccagttgcttatctttcatccaagatgcacccaaaatcctgccgtcttaacacataagttattgttataatgtctgtataacatattctgttctttttgcatttaaacttacggtaaatggggaagaaaaatatttctctgttaccactgtcttcataactaacattttaatgcctgtataataattctgccgacggcctataatgctcttaatttccccccgtggttggatatttaagtggcttccaatgttttgctattataaataatgagcatcttcatgtaccaaatatcctcaat

SEQ ID NO: 446929 - DNA, 6434 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcgttgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtagacaatatagattttgtctttgccctctgtggtggttgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaataaaaaaatg

SEQ ID NO: 446930 - DNA, 4284 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 446931 - DNA, 4148 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcagggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 446932 - DNA, 4248 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 446933 - DNA, 4348 bp, Homo sapiens
  misc_feature (4326)..(4326): n is a, c, g, or t
  misc_feature (4335)..(4335): n is a, c, g, or t
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcaaaaaaaaaaaaacaaaaaagaaataaaaaataatagaaagangaaaaacanaaaaaaaaagaaa

SEQ ID NO: 446934 - DNA, 3551 bp, Homo sapiens
gggaaattgttgtagtcttttgatggaatttataagctatgttttatttataggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 446935 - DNA, 2082 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggcaacaaatcacaggttttaactgaatttcgaaaacccagtgttacagaaaccaatgaaataggaagaaaaatacagttctgagcagtccttgaatcaacaaatatctacctttaaggaacttctaattctcattttgtaaatcccattattcaagaaaagcacattaagcttagagtaggtttgatcaagatgtttagaattaaggaaataaaacttgcctttggtgtttaaggacaat

SEQ ID NO: 446936 - DNA, 1787 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggactagctctgtactccagggcaccacagggggga

SEQ ID NO: 446937 - DNA, 3052 bp, Homo sapiens
cgaggatccaaataccatggagctgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaataaaaaaatg

SEQ ID NO: 446938 - DNA, 371 bp, Homo sapiens
gggctctttggatctaaacctgccactgggttcactctaggaggaacaaatacaggtgaggaggatctgatcacattgtcagagagtaggcttgggatattctttcctaaattgtgtcctgtatctctctttacaaggatcatcactggtagtagaccttaaaaaatggtaaatgctaagatgaaaagaaatgcaaggaattggaattaagggctagtgataggcccaatcattgactgtcatctactctgatataacgaaggaaaacatacaaatattaatttaaatttttggattatataatgtagtgtttttccttagtggagattgtggtttaagccagctttatcaatttggaacattaacatacg

SEQ ID NO: 446939 - DNA, 294 bp, Homo sapiens
caatcttcttagataagaaatcttcatgtcagatgaattgttaaaattattttatagatcctatttacaataaatttatgttttttataaagagctttgaaatcatccagagaagccatacgtgcttttttgctatattttcttgtgtcttaatactctaatactctattaaaactcagctgtcaactttttaaaatctcaatgaccttaatacatgttttgcatttttcttagggatagtaaagctctgaaggatgaaaatctacctcctgtcatctgccaggatgttgaaaa

SEQ ID NO: 446940 - DNA, 4311 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcaactgattgggatcctctagatggcgtc

SEQ ID NO: 446941 - DNA, 4213 bp, Homo sapiens
agcggggatcctccctccccatccgttccgcgcgagagaaatgctgaccggctgtgtttcgctttgactgcatgatgacctgtccttatcaccctattctctgccttgcttgacggttctgtcgtatgtccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 446942 - DNA, 4370 bp, Homo sapiens
  misc_feature (4348)..(4348): n is a, c, g, or t
  misc_feature (4357)..(4357): n is a, c, g, or t
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcacgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcaaaaaaaaaacaaactaaaaaagaaaaaaaaaaaacaaaaaagaaataaaaaataatagaaagangaaaaacanaaaaaaaaagaaa

SEQ ID NO: 446943 - DNA, 6105 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcgttgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtagacaatatagattttgtctttgccctctgtggtggttgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaagtcgaccggccaccaatttagtagtagtagaggc

SEQ ID NO: 446944 - DNA, 1784 bp, Homo sapiens
agcgggggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtgataagtggtgtaatgtagcagagcttaagaatagaactcaattatcactttttgtgaacaagttggaattgtcatgttactgtgtaattgatttgctttacaatgaacaataaatttaataaaataaaaaaatg

SEQ ID NO: 446945 - DNA, 898 bp, Homo sapiens
ccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggaacgtctaggtaaccgcactttctcgccttcctgggccggattcacccccacccccacccccgcaaagctcccttggtgtccccatcctgtctcttccctctggcttccttcccagtggggctggagagaagcacttaatctagccgcccggcgtcgtaggcctctcgccgcggtacccgggcccagcgcggcctggtgaagtggagggcgggatgggttctgtgctgtgaggtttccagaatccacgtatagttcaggcattatttggacctagtggggtcttgactgcgtggaagggccttggggtctaccccggagctttagcgatgtgtcagtcttaggcatagaatgaacattgaatgaatgaatgaaattatagcatactgtggagttttatgatagataattccgatttcattgcagcatttgcggttttggatatgacggtgttttaataactttgtggtttttaaccagcttttcaagcttttgtgccacatgggaccttatctgtttttgttaaaaaaaacaaaaacacttttttacagtgtttattagtggtaattttctgcagtatgtgcagattagtatatctgatgcgagaatgttgtgttgtaataactcaatttgtcttttacttaaatt

SEQ ID NO: 446946 - DNA, 810 bp, Homo sapiens
tctgtgttactcatacttacatgctacccagaagtctctggcctagccaggagattttaaacaattgaaataattcatgttttcgttttagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatca

SEQ ID NO: 446947 - DNA, 3450 bp, Homo sapiens
  misc_feature (2391)..(2391): n is a, c, g, or t
  misc_feature (2458)..(2458): n is a, c, g, or t
  misc_feature (2552)..(2552): n is a, c, g, or t
gcaaaatatgttgtatttgtggcatagttcatatttacactatcataaaattatggccgagaagttaaatattctaaatgtgtcaacatagttctctgtaaaactgacttattttccaaatatattttgaaataaaacaatataaaaatgttttctgtttttaggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattatagatttttacttttagaattgcagagcccctatcccacactggagaatattttttattactgtctgttatatatgtgtctatgtgtgtgtgtatatttatgtgtgtatgtataaatatgtactttttaaaggagccttttccctcctttgattttaagataagcaatcttttggcataacattatcgtcttcctagaaaagccaagatgaagaatctatcttacaactttttctcttcagtagagaaaaacatgtaccatttcagggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatngggtcacttcagagaccattttagatgtaagtttttaaatgtaagtgttactggggctaagtcaggnactttatttaaaacatttttttttctcatttcatagctagatagttgtaagagaaatacaaagaatttacaagatgcttctctgtcatctgccntatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcgtggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatct

SEQ ID NO: 446948 - DNA, 3857 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatca

SEQ ID NO: 446949 - DNA, 3982 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcactttta

SEQ ID NO: 446950 - DNA, 3900 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcactttta

SEQ ID NO: 446951 - DNA, 2727 bp, Homo sapiens
  misc_feature (1668)..(1668): n is a, c, g, or t
  misc_feature (1735)..(1735): n is a, c, g, or t
  misc_feature (1829)..(1829): n is a, c, g, or t
tctgtgttactcatacttacatgctacccagaagtctctggcctagccaggagattttaaacaattgaaataattcatgttttcgttttagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattatagatttttacttttagaattgcagagcccctatcccacactggagaatattttttattactgtctgttatatatgtgtctatgtgtgtgtgtatatttatgtgtgtatgtataaatatgtactttttaaaggagccttttccctcctttgattttaagataagcaatcttttggcataacattatcgtcttcctagaaaagccaagatgaagaatctatcttacaactttttctcttcagtagagaaaaacatgtaccatttcagggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatngggtcacttcagagaccattttagatgtaagtttttaaatgtaagtgttactggggctaagtcaggnactttatttaaaacatttttttttctcatttcatagctagatagttgtaagagaaatacaaagaatttacaagatgcttctctgtcatctgccntatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcgtggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatct

SEQ ID NO: 446952 - DNA, 6522 bp, Homo sapiens
  misc_feature (5463)..(5463): n is a, c, g, or t
  misc_feature (5530)..(5530): n is a, c, g, or t
  misc_feature (5624)..(5624): n is a, c, g, or t
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcaggtaatcagcacatttcttctttgataggcttggagttatgggggataacacagattgcttctaaatagtttgggtttatctattagcatttagccaaagtatgaattttattttttactgtcactcatgttaacaaaggtggtgtgaacatgtcgtgattagatatcctatgtaaccttaaactataaaggtaatacttatgtaagaactaatttaaatgttttgtatgagttaaatgtttgaataacattatttaactttattcggggagaggatatgtttacagtttttacactgaatattctgtaatttaccatgcaattgaattactaatgaaatgttaaaagagcatatcatacctctgcctcagttctcttctaagtaagctttttatgtagtcacgcaattaagactgtcaagacatatttgaatttcattttgaatggtgccagtggccctgtgctcctggttgatacagcatttatacccagtttgtcttactagctaatttaaactctgagcacatccctgtcaccttcacaactataaatgaaatatcttgccatatatgtagaaaataatttcatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattatagatttttacttttagaattgcagagcccctatcccacactggagaatattttttattactgtctgttatatatgtgtctatgtgtgtgtgtatatttatgtgtgtatgtataaatatgtactttttaaaggagccttttccctcctttgattttaagataagcaatcttttggcataacattatcgtcttcctagaaaagccaagatgaagaatctatcttacaactttttctcttcagtagagaaaaacatgtaccatttcagggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatngggtcacttcagagaccattttagatgtaagtttttaaatgtaagtgttactggggctaagtcaggnactttatttaaaacatttttttttctcatttcatagctagatagttgtaagagaaatacaaagaatttacaagatgcttctctgtcatctgccntatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcgtggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatct

SEQ ID NO: 446953 - DNA, 4605 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcaggtaatcagcacatttcttctttgataggcttggagttatgggggataacacagattgcttctaaatagtttgggtttatctattagcatttagccaaagtatgaattttattttttactgtcactcatgttaacaaaggtggtgtgaacatgtcgtgattagatatcctatgtaaccttaaactataaaggtaatacttatgtaagaactaatttaaatgttttgtatgagttaaatgtttgaataacattatttaactttattcggggagaggatatgtttacagtttttacactgaatattctgtaatttaccatgcaattgaattactaatgaaatgttaaaagagcatatcatacctctgcctcagttctcttctaagtaagctttttatgtagtcacgcaattaagactgtcaagacatatttgaatttcattttgaatggtgccagtggccctgtgctcctggttgatacagcatttatacccagtttgtcttactagctaatttaaactctgagcacatccctgtcaccttcacaactataaatgaaatatcttgccatatatgtagaaaataatttcatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatca

SEQ ID NO: 446954 - DNA, 2307 bp, Homo sapiens
  misc_feature (1248)..(1248): n is a, c, g, or t
  misc_feature (1315)..(1315): n is a, c, g, or t
  misc_feature (1409)..(1409): n is a, c, g, or t
gattgagcagtggccgtcggtccagagaaggtagcgaaatgagataacccatgtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattatagatttttacttttagaattgcagagcccctatcccacactggagaatattttttattactgtctgttatatatgtgtctatgtgtgtgtgtatatttatgtgtgtatgtataaatatgtactttttaaaggagccttttccctcctttgattttaagataagcaatcttttggcataacattatcgtcttcctagaaaagccaagatgaagaatctatcttacaactttttctcttcagtagagaaaaacatgtaccatttcagggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatngggtcacttcagagaccattttagatgtaagtttttaaatgtaagtgttactggggctaagtcaggnactttatttaaaacatttttttttctcatttcatagctagatagttgtaagagaaatacaaagaatttacaagatgcttctctgtcatctgccntatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcgtggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatct

SEQ ID NO: 446955 - DNA, 3735 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatca

SEQ ID NO: 446956 - DNA, 3323 bp, Homo sapiens
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatca

SEQ ID NO: 446957 - DNA, 3076 bp, Homo sapiens
aagcttgcggccgcgctgccacctcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcactttta

SEQ ID NO: 446958 - DNA, 4500 bp, Homo sapiens
  misc_feature (3441)..(3441): n is a, c, g, or t
  misc_feature (3508)..(3508): n is a, c, g, or t
  misc_feature (3602)..(3602): n is a, c, g, or t
cctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctccgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccggctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtctgcatgcacgtgtaaatgtatgcagttggatacaacggggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattatagatttttacttttagaattgcagagcccctatcccacactggagaatattttttattactgtctgttatatatgtgtctatgtgtgtgtgtatatttatgtgtgtatgtataaatatgtactttttaaaggagccttttccctcctttgattttaagataagcaatcttttggcataacattatcgtcttcctagaaaagccaagatgaagaatctatcttacaactttttctcttcagtagagaaaaacatgtaccatttcagggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatngggtcacttcagagaccattttagatgtaagtttttaaatgtaagtgttactggggctaagtcaggnactttatttaaaacatttttttttctcatttcatagctagatagttgtaagagaaatacaaagaatttacaagatgcttctctgtcatctgccntatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcgtggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatct

SEQ ID NO: 446959 - DNA, 7652 bp, Homo sapiens
aagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataaggaggcttataaaaataaattatcctccataaatga

SEQ ID NO: 446960 - DNA, 501 bp, Homo sapiens
acatagctggttgatgatgaagcctggtttctaattgaggtctgtcctgtctttggagtgagacataatattcctgcaaagaactaagcagccttacaaaggcccctgagaggttaacataaggtctgtacctagacactcctgtttctgcctgtaggccaggccttagttacggtgagttccagggcaggcaggtaggcaggagtgattatatgactgagaataaaggacagcagtgagagaagttgtattcaatgcagcacagtaaccagggacttgtaatagcttctttcacctcattcttttgtggcttggatttcctaggaacacggaagtggagctgcagatgcaaaccaggcagaaggccatgaatcgaatttcattgcccagttggcctcccagaagcacaccaggaaaaacacacaggtttctatcactcctcagctaaacttaggtgaaggcagcatgtagaaaaagatgttccaaacgtagtgctttaaa

SEQ ID NO: 446961 - DNA, 4757 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446962 - DNA, 7557 bp, Homo sapiens
aagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatggtatgtctgaaatcaggcagaaattagtttcatgcctgatttaatttttgtatttgatgatttatttctgtggctaaatagttaaggatggatgttagaaacagataactgcatggatagagataaaaggatttgttttctgttattcatcatgttgttattttctctgaatgaatgaggcagcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446963 - DNA, 3771 bp, Homo sapiens
actacatacttcgtgactacatacttccgtgactacatacttccggataacatacttccgactacatacttccgactacatacttccgactacatacttccgactacatacttctgactacatacttccgactacatacttccgaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446964 - DNA, 3161 bp, Homo sapiens
acatagctggttgatgatgaagcctggtttctaattgaggtctgtcctgtctttggagtgagacataatattcctgcaaagaactaagcagccttacaaaggcccctgagaggttaacataaggtctgtacctagacactcctgtttctgcctgtaggccaggccttagttacggtgagttccagggcaggcaggtaggcaggagtgattatatgactgagaataaaggacagcagtgagagaagttgtattcaatgcagcacagtaaccagggacttgtaatagcttctttcacctcattcttttgtggcttggatttcctaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446965 - DNA, 4550 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcaggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446966 - DNA, 4027 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446967 - DNA, 3995 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggtgagtgactactaaaagccaccttttctggaggtaaagtggggattcccttcaacctgttcaatctgaaatatggcctggatcactcagtcatactgagaactcccagcattcatagtattctgtcaagtaccattgtaggcacttgtaagtattttctctattaatctttgcaataagccagtgaggtagggatcattattcccactttacactgaaggaactgaaacacatagaggttataggtaatgagtgggagagccaagattcagaatgaccatcctctgtgggtcatcatttccctctatgcaaagtcagtgcaggtattgcagccttgataatgggtactgaccactttgaaatggagattaggtgttgccacacttaacttatgtctcagtagctcctcacagcaagaagcatcaatcatcttagtgaaatatgcctatagggcagttctgttccagggaagcattgtctctgtgggtcacattaaggccttgataggaaggtaaagatttagtgtgaatgattccaagtggatgatggggagacaccactgtagggaaagcagattttcctgtctatcccttttcctttttttcagtgtccatcctcctggaaggggcactcagaaagacatctacctccttctt

SEQ ID NO: 446968 - DNA, 2097 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacaggtttctatcactcctcagctaaacttaggtgaaggcagcatgtagaaaaagatgttccaaacgtagtgctttaaa

SEQ ID NO: 446969 - DNA, 2035 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataaggaggcttataaaaataaattatcctccataaatga

SEQ ID NO: 446970 - DNA, 380 bp, Homo sapiens
tttgtggtaccaggccaccaaagcctttgggtttgttgtgactatagtagccttactgatgttattcctctacttgccaaacaaaaaaatgttttctttgggaatcttgatgcaaaaaatagttgagaggctctggtttagaggatattctgattcctaaaatcattaactttctaattcacagcttgcatttgaatctttggctgtgattggaaatgctctaaccctcctggaagtgggtcagattgcagtgtgtaggtaaggttgctttgtaattcctttatgaaaacttttcacaacctgtttggttattttgatcacacagccaaaaaataactcctgttgtatttggttttcctcccccaagttttggagaatct

SEQ ID NO: 446971 - DNA, 395 bp, Homo sapiens
cagtgagatgagatcgtgccactacactccagcctgggtgacacagtgagaccctctctcaaaaaataataattaaaaaacagaatgtctgtatccaaggatcctccttttttaactacatacggccagaagggacagttagttgatggtctgtaaacctgaggtggttatctgataatcacttcaatgtcagaaatactatcagtctctttgacaatgagaagagcattcacatagttttctaattgtctattcctggttccggtttagtttctagagtctgttgccaacatgtttgcagctgctcagcagctctcgcagaacatcagttcaggtgagctgcatgccttcctcttcattaacaaaatgctttcttgtactctatattcccaagc

SEQ ID NO: 446972 - DNA, 321 bp, Homo sapiens
tcagaagggtcaagaaaaagacaaagaggatcctgattcaaaatctgatattaagggcgaggataatgccattgagatgtcggaagattttgatgggaaaatgcatgatggggagcttgaagaacaaggtttcagattatctgtcacttcattcttgtttttgaaagcataaatattttatccaggaaattacatgttcctaataaggaacccaatataatcttttgaaacaagttggttactgtgcttaagtgcaaatgaaaacctcagcagctgcatgtgctatcaccacctccactgaggcagaagtccctggtgtct

SEQ ID NO: 446973 - DNA, 388 bp, Homo sapiens
ccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggtatggtagtttacttttgttatgcccctgggaaatgaaagcaaatgcaaatagatgctgttgctactctgtaacaatcacactcatgaatttcctgttttcgcataattccttattggagtttccttggcttaaaga

SEQ ID NO: 446974 - DNA, 433 bp, Homo sapiens
ctctggtctttgctgaacagaaatctagaaagaaacagaatgacactagctttataaagccatttcttgaacatcatttatcttacaggaatttgttaagatttccaagtggaatgatgtcagcttctggtccattaagcaatctgtagaaaagacacacaggtaatccatcttttaaaactggagacaaccaaaatagaatagaattttgtgtggtagggagcaaaacgacatagttaccataacctaacttaatattaagtgtgttaaacttctcaaaaaataacaccttgattgttttgatgttgctttcaacaccacccccttcttctccaagcaaagtctacctgcagtaaggattagtgtgccttgagacaaagcaggctatgtctcaagtcttctgccacccactagctgtatactttgagcaaag

SEQ ID NO: 446975 - DNA, 4701 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttgccacgtgaatctggaaacccagagggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446976 - DNA, 3902 bp, Homo sapiens
aaaaaggcaataaatctcaggtggggcccttgctagggaagcgggtccacacctctcttaaatacacaggactgggtcagtttggagatctgcctaagctcagtgccttccctttcagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446977 - DNA, 3728 bp, Homo sapiens
atcagccatccatgggataggtccaataggcagaaattatgcatgtctaaaagtcaacccatgcagaagcagtttcttggattgagtgtgatgattgttttttcttcctctgacatttaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446978 - DNA, 1846 bp, Homo sapiens
aggttgctttgtaattcctttatgaaaacttttcacaacctgtttggttattttgatcacacagccaaaaaataactcctgttgtatttggttttcctcccccaagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446979 - DNA, 3820 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcaggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgta

SEQ ID NO: 446980 - DNA, 2789 bp, Homo sapiens
ccccgcgtccgcccacgcgtccgcaaagagactttcaactagtgccatttgtgagtctctttgctcaacctccatccctggaagaatgaacaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaaccttgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagaattaacggggcaattcctaacccctgttggtcctcagaatcacatggcctatgcacactcccgctaaaccactgaagtccaatttctgggagctcagccagggaatgtgtatttttaaacaagccccctaggttactctgataagtgcaaagtcagagagcgctgctctcatgcactgagcctgagcactcttctattaataaaaaaggagaggagaatcctgggttgggtgcccttcgccttctggcggcagaagagcagagccaggctgtaagcacctgcacccaccgctgggctcaggagttgcgctggagaatagaagggctaatttagtcattcatgcctttttagagcaaattacatgtggagaaggtggggcacactgaattttattttagccaaatgccccttatctccttatacaattgatatttttatattgaacattagaggattggtcatttgtcatcaagtcgtctgtaatacagaaaacgataaatacaacctaacagttcaaacatgacgagttaaataaatgatggttaaaaata

SEQ ID NO: 446981 - DNA, 547 bp, Homo sapiens
attgtcacaagaggcaatgaaggtcattgtataatgataaagaggtcaatttatcaagatgatacaattctaaatatatttgccaccaattttggagcacataaatatgtaaagaaaaaatataactgaagggagaaatagatagcagtacagtaatcataggggtcttcagtgctttcaataatggagaaatcatctagacagaaaatcaataaagaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcaagtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaac

SEQ ID NO: 446982 - DNA, 5414 bp, Homo sapiens
ggaacagcaggcgagcagtgtgactggggcaggaaagagaagggagggagaggagggtgtagaagggggttaggtcagggaggtttggggctggatcaggtcgtcggtcttgcgggctggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446983 - DNA, 6028 bp, Homo sapiens
ggaacagcaggcgagcagtgtgactggggcaggaaagagaagggagggagaggagggtgtagaagggggttaggtcagggaggtttggggctggatcaggtcgtcggtcttgcgggctggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttcaaaaaaaaaac

SEQ ID NO: 446984 - DNA, 4924 bp, Homo sapiens
  misc_feature (4841)..(4841): n is a, c, g, or t
  misc_feature (4851)..(4851): n is a, c, g, or t
  misc_feature (4856)..(4856): n is a, c, g, or t
  misc_feature (4858)..(4858): n is a, c, g, or t
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataaatacctgggtaagttttggnaatttaaatnccaantnaataataatttttaggtaatggaaaaaaattttgggaaaagggttggaattaaggaaattttggta

SEQ ID NO: 446985 - DNA, 6010 bp, Homo sapiens
ggaacagcaggcgagcagtgtgactggggcaggaaagagaagggagggagaggagggtgtagaagggggttaggtcagggaggtttggggctggatcaggtcgtcggtcttgcgggctggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatgatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagagatgggacaacaaagaaattctagcctttggagacatctagaccagcactatatgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446986 - DNA, 5281 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcacttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446987 - DNA, 5275 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaaccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446988 - DNA, 5275 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446989 - DNA, 682 bp, Homo sapiens
gcaataatatattttagtattaatacaaactacagtattatacactacactggtaataaataaagaaagtataaaaataagacacataaatataaaagtttctaaaactaaaagtacatatgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446990 - DNA, 1264 bp, Homo sapiens
cagctgtttaaggaagacagagcaggcattggataatattcttattaagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagagatgggacaacaaagaaattctagcctttggagacatctagaccagcactatatgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagtaagtctgatttttttttgtaatattgtattctcatgattcgttttttaaaatatatattaactgaaaagataaattggatgaaaagtttgaaatcaatagtaaatttggctatcaataaatattaggtgtcctacttactaaaaagtggattatgaagcagaataagcaagttattttgaccatatttacaatgcatataatgtattgaaatttagtagaatttattaaccaggatcaagctttccaaatattgttgatataattgaacctacctttaattttttattgtaaccccgaatgaatactctacttagaaaccaataaatatcatatagatatagtgaaattataattcaatatgcaaaaatcccaaacacatataaatcatggaggtatttttagtgcttgtaaacctctctatacatacatcagaatcctttaagtaaggtggttttttcactttaaatttttacttttactcaaagtatggctgagtggaaggagcggtgaaagtaaggagaccctctacttgctgcactttcagtgagtaaacactgaaagtttaatcttcttcctc

SEQ ID NO: 446991 - DNA, 821 bp, Homo sapiens
cagctgtttaaggaagacagagcaggcattggataatattcttattaagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagagatgggacaacaaagaaattctagcctttggagacatctagaccagcactatatgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacatggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaac

SEQ ID NO: 446992 - DNA, 324 bp, Homo sapiens
acataggaaagcactatcaagaaagactaatggagtgactatcaaaaggaagtcaatggtaagagttttcatttaaattgtgtgtgtgtgtgtgtgtgtgtgtaaagcctaccaatgtattatatttgaattaaaattttagaacttttaaaatctaggacataatgacaagtgtttgaattttatatgtctgtcacttatattttaataaaatatatgcaaagaatggttttatagataagagattttacatacttaatgttgataaatagtataaaagtatggaaaatcaattatatagttcatgtctggtttaaaaattca

SEQ ID NO: 446993 - DNA, 817 bp, Homo sapiens
agaaaattatataggtcggtgaaatgggataagaaaaaacatacttgaaagagtagaatgtaattacttttgatacttgagaattatttgaagttataaagattggtggaaatattatacacatatgctgagaagattccatgattggttagcagaacatgtacctcagacttagttactagcgttcatcacatctatgtaggttttgaagctaaaaagtttattctaaatacagttctgtcacaagcatgcatggcagtcttctttttaaaattgataccgcttgttttagggaaatgaggatacataaaaatttatatgtaataattcagtgaatataatttgtttgtttgtttgtttaggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgta

SEQ ID NO: 446994 - DNA, 5337 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtgtgtgtgcgcgtgcattgattactatccatttctttagtcaacgctctccacttcctgatttctgctttaaggaaaactgtgaactttctgcttcatgtatcagttttaaagcatcccaggcaaagatcatctacagattctaggaattctctcccctgaaatcaaaacctggagacttttttttcttattttagttgagaagttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagataggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccaagttacttgagggtagggaggcgggcccagtgcaggaggctgcatccctggcctgctggtgcccaccgggggctgtgcctgtgccgggccgcaggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagaactacgtgatctgattgagatgtacatagtttttttttttaccataactgaattattttatctcttatgttatcatgagaaatgtatgccaaatgattagttgatgtatgttttttaatttaatatttaaataaaatatttggaagg

SEQ ID NO: 446995 - DNA, 5336 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446996 - DNA, 5737 bp, Homo sapiens
cagctgtttaaggaagacagagcaggcattggataatattcttattaagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagagatgggacaacaaagaaattctagcctttggagacatctagaccagcactatatgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446997 - DNA, 4873 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctga

SEQ ID NO: 446998 - DNA, 3619 bp, Homo sapiens
attttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacacacacacacaaaataaatccgggcccgttcc

SEQ ID NO: 446999 - DNA, 4055 bp, Homo sapiens
gcgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaagaacttgatggagagtttggattcattgctttgtgcagaaggttctgaaagtctgaagagtttatgtctgaaacttctcctttgcttagtgaccgtgacagataacatcagccagaacactattctcgagtatgtaatgatcaacagcatatttgaagcaattttacagatactttcccatcccccaagtcgtagggagcatgggtatgatgctgtcgtcctcttggctttgctggtgaactatagaaaatatgagtctgtgaatccttatattgtgaagctgtctatcgtggatgatgaggccacactcaatggaatgggacttgtaattgctcaggctttatctgagtacaacaggcagtataaagacaaggaagaagaacaccaaagtggttttttctctgctttaacaaatatggtgggcagcatgttcatagcagatgcccatgagaaaatctcagtacaaaccaatgaggccattcttctggcactttatgaagctgttcatttaaatcgcaacttcatcacagtattagctcagagccatccagaaatgggcttggtgacgacccctgtcagtcctgctcctacaaccccagtcacaccacttgggaccacaccgccttcctctgatgttataagttctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagaggatcaatatgccaatgcatttttgcatgatgacaacatgaattttcgagtaaacttacatagaatgcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggtcttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtcaaaa

SEQ ID NO: 447000 - DNA, 329 bp, Homo sapiens
ccagtatgagcgctactcagagcagcacaaggaagctgccttcttcaaagagctggtgagtgccccaccgcctctgcctgtgtcttaggggcccgcccccagccactgggttctgcagtttatctgcagtttatctgcagataaaacaagacttgaggggtctgctgggatggggtatgcaacttctctcccccattgtaccaggcagtaagagaagatgctattcgaggtagtattgcctacttctcctttgcagccatggagacagcccttgcacagctccagctgggcctggggtttgacgtgtgttcccagcagcagatctggct

SEQ ID NO: 447001 - DNA, 669 bp, Homo sapiens
gcgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaaggtgaggcataagctgcagatgtgcctgtggatggcagcttctgacagctgttcctggacactatcagcagacaaatgtactcaaagatttggactcagaaagatacagatgattgaatttggccttgcatttagatgtttttatttcacagatttgctttatctgaataaaggaaaattttaaattcaaatttgaatggaggt

SEQ ID NO: 447002 - DNA, 1417 bp, Homo sapiens
gcgggaacggcgcgggtggtagaggaggagccgcgggctcgattctctaaccatggcacaggtagagaaacgtggaggtttgctccggaaatcttcagcctccaaaaaaccactgaaggaaaaagtggtgctgatgtatgatgagatcttcatgacagaggaccccagtaagtgcagtcctcggttttgggaggagctctttctcatgaaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcagaccctgtgcgcactcattcgaggagtccatcaaaagaataagtctacctctgggtttgacattatcaacatgctgatgggctttgacaaggcggagctgtgcatgaagaacttgatggagagtttggattcattgctttgtgcagaaggttctgaaagtctgaagagtttatgtctgaaacttctcctttgcttagtgaccgtgacagataacatcagccagaacactattctcgagtatgtaatgatcaacagcatatttgaagcaattttacagatactttcccatcccccaagtcgtagggagcatgggtatgatgctgtcgtcctcttggctttgctggtgaactatagaaaatatgagtctgtgaatccttatattgtgaagctgtctatcgtggatgatgaggccacactcaatggaatgggacttgtaattgctcaggctttatctgagtacaacaggcagtataaagacaaggaagaagaacaccaaagtggttttttctctgctttaacaaatatggtgggcagcatgttcatagcagatgcccatgagaaaatctcagtacaaaccaatgaggccattcttctggcactttatgaagctgttcatttaaatcgcaacttcatcacagtattagctcagagccatccagaaatgggcttggtgacgacccctgtcagtcctgctcctacaaccccagtcacaccacttgggaccacaccgccttcctctgatgttataagttctgtggaactcccactggatgcagatgtacagaccagtaatctactgataacctttttaaagtatagctcaattgtcatgcaggacaccaaagatgaacacaggcttcacagtggcaaactctgtctgattatccttacatgtattgcagagcctatgagacacaggaagaaggcagcagacaagaatcttccctgccgtcctttagtatgtgcagtactggacctgatggtagagtttattgtaacacacatgatgaaggagtttcctatggatctctatatgtaagtacaaatatgtacacattta

SEQ ID NO: 447003 - DNA, 1008 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447004 - DNA, 857 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447005 - DNA, 518 bp, Homo sapiens
cagagtctgtacctagtctatatattagactatatattgtttccaaatatctgagcccccattggctgtacagcaaggcagatgggttaagaatgtgcagggaagaaatgaaagttggatatggattaaaagattggctgtggagctgactgcaggcagatgattcaaagcttttgttttggtttcagatcgtgaaagaggcttacccagaccacacacagtttgagaaaaacaatccccattatgacccatctagcaaagaggacaaccctaagtggtccatgagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447006 - DNA, 1171 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaaaaaaaaaaaaaggggggccgcccaaataccgcagggccagtaccgaccgctttgttcaagggccaaagggctttaaaaacacggcctcaacggggaagtccggctggaccctttgggaggaaccaaaagcacaaaagtagccaccgcggcagcgtaaaagact

SEQ ID NO: 447007 - DNA, 960 bp, Homo sapiens
taatttttatagataaggaaagcttcttaacagtaagattaagttcctacagctggtaatggatccatgatttgaatccaggtctgactccaaagctaagctttttccattatgaaacattgcctttaacaagcatgatcttttctttttgcttctcctattgcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447008 - DNA, 1214 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtaaagactatgctttctatttcatgacaggggaaggatgaaccaggggaagaagacggttggggtgactgtaggtcaaggtacacggcccagcacttactcagatgaggtgatactgagataggagcttcctgtgggcggttaaaaatacagtgggcacagtcagcctagacacgtctttctgtcatgtacactgttgtcacatagtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447009 - DNA, 785 bp, Homo sapiens
ggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447010 - DNA, 641 bp, Homo sapiens
cagagtctgtacctagtctatatattagactatatattgtttccaaatatctgagcccccattggctgtacagcaaggcagatgggttaagaatgtgcagggaagaaatgaaagttggatatggattaaaagattggctgtggagctgactgcaggcagatgattcaaagcttttgttttggtttcagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447011 - DNA, 1123 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaaggttagttgggcaggttttggtgtgaatcccttttcctccagggagactaacttaagtagatataaagggatataccttaattaggcaacaaaaaagtacactcccccccaccccatcccccttttacaggaatagggaaaaactgccctggccccttcctatctgataactcaaagcaggccttcattcaggtccgactagcacagacttcactccacctctaagtcttgatctcactcgaaaacaggcctgatg

SEQ ID NO: 447012 - DNA, 895 bp, Homo sapiens
tttaacaggtgaggcggaatccccaggtttaagaacttggaagtttcaggaatacatattaagaattatgtatttaggtataaatgagatcagaaagaacagcccaaagaatagagtggtgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtaaagactatgctttctatttcatgacaggggaaggatgaaccaggggaagaagacggttggggtgactgtaggtcaaggtacacggcccagcacttactcagatgaggtgatactgagataggagcttcctgtgggcggttaaaaatacagtgggcacagtcagcctagacacgtctttctgtcatgtacactgttgtcacatagtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447013 - DNA, 367 bp, Homo sapiens
gatactgagataggagcttcctgtgggcggttaaaaatacagtgggcacagtcagcctagacacgtctttctgtcatgtacactgttgtcacatagtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccagggtaagagtgggccctctcctttattgtccatataccagaatgacctcatgaattcccacttactagctgattaaacttgggcatggtacttcacctttctcagtcagcatcctcacctgta

SEQ ID NO: 447014 - DNA, 798 bp, Homo sapiens
cgctgcacagcctgcggcgcagcggaggcggaccgcagtcgagtctgcagagtgttgggtctgtagccagcaaattacttcatcatctagattatccattcagttgatcctaattagcaaggataacaagaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcaggtgagctgcccctaggctgcacaaaggcagcccaagaaaaaacttttctcgaagagcctgtttagtactcatttttcactccctgctttttgagaaccctttgtgatatttttactccattatccttaatcactctccatcttctttacttgtctcaccaagctcctacctacagttcctttttcttgtttattcaggcaatggttgttgtgcacaaagactctttgagataccaggtggcgtgctaaagaatataaagcgcctgcttgcgggtgaac

SEQ ID NO: 447015 - DNA, 1321 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447016 - DNA, 936 bp, Homo sapiens
ggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447017 - DNA, 1155 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcaggcacattctgattgtcttgggatgaaatcgaatcatcaccatttttctacaatgtcctgaatgaactgtttctttcaacttttattggcaccttcaaggagcagaaaggagatgggccaggagccacagtgagcaagaaggaaagacacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447018 - DNA, 1156 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagttacctgttactattacccagtactctatagtgcttggcacctggtaaatagttttgaacgaatgactgctcgccttagtaccatgtaagatgtacctgtgcctggcacaactttcctgttcaagaggggacattaaaaactaatccttcctttttccctttttttttttgtagaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447019 - DNA, 1101 bp, Homo sapiens
ggggtcgcgctgcacagcctgcggcgcagcggaggcggaccgcagtcgagtctgcagagtgttgggtctgtagccagcaaattacttcatcatctagattatccattcagttgatcctaattagcaaggataacaagaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgatttagctatcttgagacactaggaggtgaaacgagaactctacgttaatatctgatatactacctgcctcgcggatcgcgagtcgacgacactagctccaaagaagtcaccttttttcagacagtgt

SEQ ID NO: 447020 - DNA, 879 bp, Homo sapiens
ggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgaggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 447021 - DNA, 1783 bp, Homo sapiens
ttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtctt

SEQ ID NO: 447022 - DNA, 4483 bp, Homo sapiens
ttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaa

SEQ ID NO: 447023 - DNA, 4413 bp, Homo sapiens
tggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaa

SEQ ID NO: 447024 - DNA, 4429 bp, Homo sapiens
ttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaatacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaa

SEQ ID NO: 447025 - DNA, 4500 bp, Homo sapiens
cacgcgtccgcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaa

SEQ ID NO: 447026 - DNA, 4440 bp, Homo sapiens
cggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaaaaaaaaaa

SEQ ID NO: 447027 - DNA, 3186 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 447028 - DNA, 3160 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaagtgaggccctggggccagaggtgtgggatgctgggtggccatggagaggagccatgactgcacccaccctctgactccacagcccatactctcatcaatctcattgcttccctgcccccgacttctgtgaccctgtgaccacagaccccattgcttccatgacgtcttgacctcattaaccatgatctctcatctctccatctcgctgactctgtttctgttctcagagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 447029 - DNA, 2873 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 447030 - DNA, 2782 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccag

SEQ ID NO: 447031 - DNA, 2077 bp, Homo sapiens
  misc_feature (1782)..(1782): n is a, c, g, or t
  misc_feature (1786)..(1786): n is a, c, g, or t
  misc_feature (1809)..(1809): n is a, c, g, or t
  misc_feature (1942)..(1942): n is a, c, g, or t
  misc_feature (1944)..(1945): n is a, c, g, or t
  misc_feature (1956)..(1956): n is a, c, g, or t
  misc_feature (1969)..(1969): n is a, c, g, or t
  misc_feature (1971)..(1971): n is a, c, g, or t
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctcgtacacaggctggctgncaanatgccatccagactgaggaaganccggaaacttaggggctacgtgagccacggcaggcgcataggcaagcacggaagcacccggcggcgcggtaatgctggtggtctgcatcacagcggatcaattcgacaaaatacaccaggtattgggaaagtngnntgaagcttacnttagagaacgagntntgccaatgtcactgcaatgggttggcctgacgccggtgagtctaaacaaggggcccctggggggggggttatggagggcccagggggattaaaggaaagggggggg

SEQ ID NO: 447032 - DNA, 784 bp, Homo sapiens
gaggcatagatctcctcctctctgaatcccatgcccccatcagccacataccacatagggaggccacagatgggccgtggtgggtggtggtagcctttgcaccatggtgagcagagacggctggctctcctcagggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcggtcagtatggctagaccctctgcagaacccttcctcacttcaatctgaccctgcactttcattcatttattcattcat

SEQ ID NO: 447033 - DNA, 2933 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 447034 - DNA, 2698 bp, Homo sapiens
gccgtggtgggtggtggtagcctttgcaccatggtgagcagagacggctggctctcctcagggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 447035 - DNA, 3056 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagactaccattctcattcattcattcaacaaatatgtattgtgcacctaattggtgccaggtctggggatatagcatgaacaaaacaaacagggcccctgctcttatgaatcctccgttgtggaggg

SEQ ID NO: 447036 - DNA, 1892 bp, Homo sapiens
ttttctctgcttttcgctaccccggtcactctcatttctctcccctattccttgtctcttcccccatccccctttctcctgtcctccccctgcctctacagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcttgctcctccacagacccctgggatgacttcattggaaagaacatggacagggt

SEQ ID NO: 447037 - DNA, 559 bp, Homo sapiens
ttccatctcaaggtaaaactcctagaggtatacctatctaaacctatccttggtaacagtcacatagagtgtgtctcatacattataaattacaaatttttagttaaaaattaatgatgctttattcctgtttgagtttctttattactcaaacttggcccacacagtggcaaaatgggagattttgtgctacaaatagtgttggggatgggggagtgaaaggttatttatgggagatttttaagtctattcctggattaataatttttcaggttgaaaaatgcctctccagaagatgtggaatattataattgccagcaagaacttacagatgatctacataaacagtatcaaatagtggaacgtataattggttagtgataaatgattctagttaaactttctttttatgcttgaaataatctgaaaaaagtcataagtttgccacttacatatcaaacacagtagcttgctcttactaaaacagtattgtaaactagatagctaaattttacttgtgtagcctttactaagaattatgtatctgatgattaaatgt

SEQ ID NO: 447038 - DNA, 7014 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447039 - DNA, 7911 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggtatgtattagtgcttttaaaattataaataattttgatttagtatcagtatattacattattatattcagacatttttaatcttcatatctagtttgataaaaaaagagtggtgttagccacctttgattagcaaatgaggttttaaagtcactattctagtttaaacctaaggattttatctttgagacagagtctcactctgtggcccaggtggaggttgcagtgagccaagataaaaagagtgagactccgtcaaaaaaaaaaaaaaaaaaaaaaaaatatatatatatatatatatatatatatttagtctccaatcccatctaggttgctgcaaatgccattatttcattcttctttatggctgagtagttttccactgtgtatgtataccacagtttatcttcttgttgattgatgggcgtttgggctggttccacattgttgcagttgcaaattgtgctgctgtaatcgtgtgtacaagtatctttttcatgtaatgacttttttgctctgggcagatactcagtagtgggattcctgggatcaagtggtagttctacttttagttcctttaaggaatttccacgctgttttccatagagttctttttttggtatatgccttttattttttaaggaaataaaatttacagttagagttgaagtgtcattcctttcctatcccgttttctttctttttcaccagaagtaaacactgtattgaatttggtgttaataacatatatatttgattttggagtctttttgttgattggtcttgctagatgttattagttttaaaaactgcctttctgtttaattagtaccatactgcttacgttcaaaaaatcaattgaaaaatttttcattttgattattcaatttcttacaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447040 - DNA, 6917 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaacaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447041 - DNA, 5897 bp, Homo sapiens
tgtctaatgcagtaaaagttgtaagaagattcagataaataatgcagctgaccatctttttagcaaatttgaggggaaaggattaatacactgtaataattatgttacattagcctgttctgtgtatagctaatggttcagaaaacaagttgtgttctcatgagtattatgaaagaggtttggtccgttgtatatacagctgtgaattttataacggtacagttttactttggtactatcgttggctttttttgtttgttttaatgcttttagaatttatcctggtaattgttctgctaaacatcgttttcataatttttttttttaagatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggtatgtattagtgcttttaaaattataaataattttgatttagtatcagtatattacattattatattcagacatttttaatcttcatatctagtttgataaaaaaagagtggtgttagccacctttgattagcaaatgaggttttaaagtcactattctagtttaaacctaaggattttatctttgagacagagtctcactctgtggcccaggtggaggttgcagtgagccaagataaaaagagtgagactccgtcaaaaaaaaaaaaaaaaaaaaaaaaatatatatatatatatatatatatatatttagtctccaatcccatctaggttgctgcaaatgccattatttcattcttctttatggctgagtagttttccactgtgtatgtataccacagtttatcttcttgttgattgatgggcgtttgggctggttccacattgttgcagttgcaaattgtgctgctgtaatcgtgtgtacaagtatctttttcatgtaatgacttttttgctctgggcagatactcagtagtgggattcctgggatcaagtggtagttctacttttagttcctttaaggaatttccacgctgttttccatagagttctttttttggtatatgccttttattttttaaggaaataaaatttacagttagagttgaagtgtcattcctttcctatcccgttttctttctttttcaccagaagtaaacactgtattgaatttggtgttaataacatatatatttgattttggagtctttttgttgattggtcttgctagatgttattagttttaaaaactgcctttctgtttaattagtaccatactgcttacgttcaaaaaatcaattgaaaaatttttcattttgattattcaatttcttacaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447042 - DNA, 6458 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttaaaaaaaaaaaaaaaaaaaaaaaaaaaaaaaaaacaaaaaaaggggggggcataaaaaccccgggggccaaaaaaaacacaattgttaaaaagcgccccaagaggcacgaataaaacgagcagaggcgaaaaacaacgagcaagggaaaacaacacgaacatggaggaaccccgggggggacatggaacccccaaaataaccgagagactaaaaggtctagaaaacaagtagagaaagtccatataaccac

SEQ ID NO: 447043 - DNA, 6325 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447044 - DNA, 419 bp, Homo sapiens
atgaatggacgcatcatcagaccaaacggttaaaatttaatatattgttaacaacttatgaaattttattaaaagataaggtatgtatttatttctcacgtgttttggtctcttgtatatcagttttttctttatcatatgctgtggacaagatgagagaatagcctaaatcgtgagtcagcaagctatagcctgtggtcttatttttttaatggtgcttgaactaagaatggtttttacctttttgaaaggttacatttaaagggtcttagaaagaatatgtaacagagaccatatatttatctgcaaagtctgaaatatttactatctggctcttcttagaaaaagcttgccaactcaatcgaatgaaaccagtttgttatagtgtgtattgatttgtaagctctttaaagaagagg

SEQ ID NO: 447045 - DNA, 177 bp, Homo sapiens
cagttgcttggtgttttgtagaattatgttttatacttttaaaaatactggtttttttaaaaaaaatcaaggtggtagactcggaaaagtgaagggtccaacattccgaatatcaggagtacaggtgaatgccaaactagtcatctcccatgaagaagaattaatacctttgcacaa

SEQ ID NO: 447046 - DNA, 621 bp, Homo sapiens
tactctgaaatattttactatcttttaatagtctatatttaagactccttagaatagtgtgctacaatataaaaaataaccatttttgtagaagctaagtaaaatccaaaacttttacttactcaaagactgattttaaatgataacagaaaggcttgctctcctgaagaaaatctaaaggggaaagaaccctgatgtataagatttgtgaagtgagatttaattgcttattttgctatcaaacagtgttataatattatactcatgtaaatatcattgaaggaggtagaccttgttgaatttaggtttttaatacatgtgtttatattcttgttttctcattttaaagtgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaagtaagtgatacacttttcaggaagtgttaaatttatattatataactgtctttttttttttttgttttctttcctgattctgaagtttaggta

SEQ ID NO: 447047 - DNA, 357 bp, Homo sapiens
gtttgaaattgtttattttcaaattatagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgaggtaatcaataaaatacccaatgaaaggtagattgcttgtattactttgggaaaatttagaggattggtttataccattcttaatctagcttttagagaagacaacattttaaattaaaatttactt

SEQ ID NO: 447048 - DNA, 5943 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttcccttt

SEQ ID NO: 447049 - DNA, 6835 bp, Homo sapiens
tctttagagcaaaaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcattaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447050 - DNA, 4937 bp, Homo sapiens
cacatcaataattttcaaactttagtgtgcatcagaattaactggatggcctttgctaaacaccttcagtaggtctggggtaggactcaataatttgcttatctatgttctcaggtgacactaatgctgttctagtaaccacgctggacttaatcagtgtttttaaaactgaattgtaacctgttaatggatctgtgaatcagtttaatgggttgcaccaacattttgaaagtaaaatgataaaacatgagagtataacatagtatatcatgtcatgatatgaaactgtttcaggtgtttgcaaacagctatgtactcaatcacatacttttagaatggggactcaggcagaatagtatgacagcctatgctgtatttactcttgagggtgcagtcttagtgatttggagcacagactaaagacagaatgcctgagcattattttactgtctagtaagtactttctattatagttttagcaaaggacatgcttcacatttctacttaattttataattgattttaattgctttgtaatactttgattctgtttatgcagtattttaatgtgtttttttctagagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447051 - DNA, 5834 bp, Homo sapiens
cacatcaataattttcaaactttagtgtgcatcagaattaactggatggcctttgctaaacaccttcagtaggtctggggtaggactcaataatttgcttatctatgttctcaggtgacactaatgctgttctagtaaccacgctggacttaatcagtgtttttaaaactgaattgtaacctgttaatggatctgtgaatcagtttaatgggttgcaccaacattttgaaagtaaaatgataaaacatgagagtataacatagtatatcatgtcatgatatgaaactgtttcaggtgtttgcaaacagctatgtactcaatcacatacttttagaatggggactcaggcagaatagtatgacagcctatgctgtatttactcttgagggtgcagtcttagtgatttggagcacagactaaagacagaatgcctgagcattattttactgtctagtaagtactttctattatagttttagcaaaggacatgcttcacatttctacttaattttataattgattttaattgctttgtaatactttgattctgtttatgcagtattttaatgtgtttttttctagagattagatggatcaataaaaggagaactgaggaaacaagctctagatcattttaatgctgagggatcagaggtatgtattagtgcttttaaaattataaataattttgatttagtatcagtatattacattattatattcagacatttttaatcttcatatctagtttgataaaaaaagagtggtgttagccacctttgattagcaaatgaggttttaaagtcactattctagtttaaacctaaggattttatctttgagacagagtctcactctgtggcccaggtggaggttgcagtgagccaagataaaaagagtgagactccgtcaaaaaaaaaaaaaaaaaaaaaaaaatatatatatatatatatatatatatatttagtctccaatcccatctaggttgctgcaaatgccattatttcattcttctttatggctgagtagttttccactgtgtatgtataccacagtttatcttcttgttgattgatgggcgtttgggctggttccacattgttgcagttgcaaattgtgctgctgtaatcgtgtgtacaagtatctttttcatgtaatgacttttttgctctgggcagatactcagtagtgggattcctgggatcaagtggtagttctacttttagttcctttaaggaatttccacgctgttttccatagagttctttttttggtatatgccttttattttttaaggaaataaaatttacagttagagttgaagtgtcattcctttcctatcccgttttctttctttttcaccagaagtaaacactgtattgaatttggtgttaataacatatatatttgattttggagtctttttgttgattggtcttgctagatgttattagttttaaaaactgcctttctgtttaattagtaccatactgcttacgttcaaaaaatcaattgaaaaatttttcattttgattattcaatttcttacaggatttttgctttttgctgtccacaagagctggaggtctagggattaatttagcctctgctgacactgttgttatatttgattccgattggaatccacagaatgatcttcaggcacaggctagagcccatcgaattggccaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaagatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447052 - DNA, 2998 bp, Homo sapiens
ggcatagagcaaaggtccttccttttcaaacatttgccaatttgatgagcttctgtctcttttaattgtattatgaacttgaatgggactggcttactttagtttataggaaggtaaacattgcatgtatcattattagggggattctgggctctttcagaatccacatacatgcaatctgtagtcatatgaagaaaaattagtcgttgttaaaatttggttagtaatacattggccatacttgcactttccaggatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaagttgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagat

SEQ ID NO: 447053 - DNA, 4498 bp, Homo sapiens
  misc_feature (1004)..(1004): n is a, c, g, or t
  misc_feature (1048)..(1048): n is a, c, g, or t
  misc_feature (1689)..(1689): n is a, c, g, or t
ttagttaaaagacatggcgctgttacttgtgagcctttacaagtagtgaactaggaagtttatctcaatttcagacattaattttcattattcatttccccttaggccattctctactttaacttttctcctttaatgcctaaaaacgattacaatgacttacccaataatttaaaataatagtaacgcatttctaaaacgatttaagtgtgtctttgttagcttctgaaagaagctagtgtgtgtttttcaaagttgtcatgttatatatgtggaccatttgttcaaccagaataaaaatggtctgaaacagaattattttgctgttggaaattactttattgtgcagaactgttaaaactatgtttttagtttaaattgctatttttaaaatgtgttgaaaaatatgcaagtagaatgtgagataatacttcactttaaaaatgaacaaattgagtaaaccatcctcagacttagtcctatgaaattttcaataactgaaatgcaaaaaggtggttgtttctgttgacattaggtttgtatgaagcaaatagaggtgggcaaaaaaaaatgagctccatctgagatagtaagataactttattcccatacaatacctgtgttttcattaccaaagtagcttgtgttttatattatcagatagaccttctagtaacagtatcaaattttttgcagataaggtaattccgatttaagtgacactttttttttttaaacttggcagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaacnctagtgttgatttgtactttttctgtttttcttaccttgtgaantatttatgagctaaaattttgggaaaaagcataacctaaatctccatcatctcttacatgtttaagaacatatccatttatcataaataaaattccttatggatcttatatatctatgattgtcagtaactgaataggaaagatttacggtaaacactttttatttcttatgaatgtagaacccgaggtagtagttataggtagaacataaattgacagtgatgttttaagaacatgcattcattcagcaaatatttagtgaaggcctactctgtaccaggccatgatctgggcacttgggatactttagtgaacaaagcagacaaagataatgcaccttcaaggggcttgccttaaaaaaaaaattgttagatttaaatatacatgatattgagtatctcttatgatggccgcaaatgagccttgaattctggttctatccctgttattttcagggatatccttggaagttacttactctcttttgcttacattgaaaaactaggataaaaatatttgttctatttacctcacagtaaatagattaatatatgtatgattttggctaagttactatcaattagccgttaaaatggagggattgaatttgctgatctgttaggtctttgttatggtaaatntttatgatacttgctaattaggggggaaccaaatgaaagagcatcacatggatgagtatggatgatgatacttattttggaaatttaagaggaatgggcaaggaaaacctaagagtagaagcaagtgtcttatttcttagctccctgcctgctaacttggagcttttattctttcctttggtgaataattctttaaaaattttatatttaaatatggataaatcaagtgatgccagccagtctgaaataaaaaatcaagagattaactgggtagctagccctcttattttcaggaagaacttaagttatatgtgtccaagatcacacagggggatggttagttacagagctggatctcttaattcccaggcaattatacttttaatgatgctggtttttggtatgtgattttatttagaagttagaaaaaattttaaacatgattggaagcagaaatactgaacatggtagccctctaaagaagggaacataaatattgctcataagccaggaattactggcaggcctcagcttctcagatcaagaacaaatacttcattggtcaaactaaagtcatcataattccagcatcgagatgtctttataggttgtcacagtttggaatctctggacatatttgggtccaaagctccttttctttccaaaagaagagccctgtggagacagtcacagtgtttatggatatatagtcttcctgataaaagctattaggggattttgggtgcaataataatagttaataaaaatttaaataatttgagtagtgttagttacagttaatacatagcatgtactatgtgccaggcactatgatatgacctttatatctgaattagtagcttagtcctcataacaaacctttgagattaaatctaattattattctcatttcacagatgaagagcttggtgcaaaagtggttaagtagcttgctcagcgtcacacaattaggaagtggcagagccagggtttaaacccaggaaggctgatttgacagttacactattttgccttgtcgtattggtggggaaaaacagtgaaatatttttaccaggatgctttggagaaaatttgagttggcaatctctgttaaagtataatatttgtgagtttatctcaacctgaatggtctagcttaaaaaagaaaaacgttatactaggtggctgctttttctattttagtttttacttagaagataaatttgtcaaattagaatgaggctaattctcccaggtttctccctagtgcagaggaggcaacagccaggcagatgcccgatgctgcttcatggaagtctgttcttcatttgggtcttttctttgaaagtttctaaggagtctgacaggatacgcttgttggagggtatagctgtccatttctttaagagtttctctagtttgcttgatctgcagcactgaggttttcttgctgcacagagttcattgaggtgcacattatagtaacccactttccggtattattacagagcgaaggctccttgtaaataacccagttcctctttttttgtctccactgtttggaaattttaaatcagggaagcaactctcaggtaagtgggatattcttaccgaaaataaattcttgtggacttactccactaaaataaattattgggcctttattgttgtatccccttatcaggaaaatcacctataatttgtatgagtcagttatatcctataattaaggaagattaaggccacaatgattgaaattaaataatatttttgatctaaatttttaattgttgtcttttttcccctcttctattttgcagttcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447054 - DNA, 2007 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447055 - DNA, 2853 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaatacatgtttgagagccttatatttgggagttttgtgttgtattttttttttccttacagtgctagattctttcccttaattccacacagaacccatcgctacaatatgtgagcagatgaaaccctgattagtcccagaatgctacgaaggggaagaggaggacgtttattagagtatgctgagctgctgtggaatgacagaagtaagtcctgctctttttctggggctgtgagacatttcaaaaacagccatgcagacccctcccatagacgacatgaatgaattaagagtctatataggacctgctacaggcggctttcacaattccacttaaacacctgtgagcaaaacaaacagggctaacatattcctcactccactcagcaactgagacaccatgactgcaaaggcaggggcgcggtttgaagtttaatgcctgcttggcatttcagccatcatctctaggggtatgagaaactcgagatggtttccttgttttattaatgttcttatttggaacttactggccctttccccagatacatgtacttacacagtaatattaataatttaaattaatttgaatttgtaaaaatgacgccttgtactgaagaaatgtagctttaaagggtatatgatatagtagaaagtccttagggggatatatttttttaaaggagattcaacattggtctgtttatagctcattcttaaattgatgcttctaaaatgtatgaaaatatacctatttattttttcctgtcagctcaaaaagtctctttgcagttaggcttcccctgatcgtgctcggtaaagtctttcttcttcagcatcgaaccac

SEQ ID NO: 447056 - DNA, 2522 bp, Homo sapiens
  misc_feature (598)..(598): n is a, c, g, or t
tacctagggaggttaaggggcctggccaatgactcgttatttgaagaaggatggagatgagagtttgtttccctagtctcagtcaaatgcccttaccatttgaccctcttgcctccctgtaatgctgttgggtaataaggtcaggtaactgcattggatagagcctgggtgtgttttattgtgaactccctctctttctcctttttgttgtatctgccttagtgcttagcttctttattacaaattagatattaaatcctgttctcacattgagagcgaattctttctccagaaaggataacaaaccttttgtttgagagagatttttcactttttgaaatggtctgtttgtttgaagttacagaagaaaaataagtgtaatgcacagttgtatttattattcatgtgaccctggaaacatttcttccccgccctgtgtttcagtttcttcatctgtaaaatgaggttaataatggttcccccttctaatgttgtttttgaagattacatgagttaatacatgtaaattgcttagaacagtgcctagcactaatataatggaagtgttgcctactgcctattggcagttttctgtacngcttcaccttcccttaggacttcttgtcagcccagttatgtgatttttcacctcgtttttgtttaggagactctactttgttgatgtttttctgagaaacaatgtgctgtctgtttttctctgtttcctttgacatttgctgttcatctttcactgaatatttgtttaagaaagacatacagaatgttaattttcattgattgtagctttcttctttttaaggatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447057 - DNA, 1931 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447058 - DNA, 1637 bp, Homo sapiens
gagtgtggtggaattcgcagagcagggtggaagatggtgaggaggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447059 - DNA, 1898 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447060 - DNA, 2021 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagaactcagctccttacatgggctttggtggggcacgtggggcagcacccgcaggtctaaatcggggtgggggtgttcggtccttgcgggcttcacgagatcgattcctgactacg

SEQ ID NO: 447061 - DNA, 1438 bp, Homo sapiens
tactcagatctgatctccagaagttgtagaattctgagaagatcacccacagtcaatttaattgcttggaatatgatttttgctctttggcattgattacataggagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447062 - DNA, 1308 bp, Homo sapiens
cggagtggaaaagtctttggagaagtttttgggggcctggctggcacatgggatccactctgctctccaggaagcgtatgccatcttctagttcgcatttctgcaccaaggcagtggcaggtggcccgaagagtgagtgggaagcaataatcagctctccaacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447063 - DNA, 1048 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacagtaagtgatgttttgcaggaggcgtcgaacactggaaacaggttctgtggtagtcccagcctttggggctggtggcaggtgcgacaggttgtacatgggcaggagt

SEQ ID NO: 447064 - DNA, 1119 bp, Homo sapiens
gtgggtgacagcgtggatgggagttacacaagatactacggaagagggataaggcgagactaatgaatggatctctcagactggggatactgagagccgtcaatactgtcgccggtgcattcttcgtcgtccagtgaacggaggcacagatgtaccgatcgttccgagcttgttaaactgagttatatgctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447065 - DNA, 1072 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaataatgctgtcggaaatctagcttggagcccaccgcagataaagttgctgctctatgtaggacacagaacttacagaatataatcagttaacaagctcggaactttttcactgtcctccttcatggcacaaagaatgtgccgggcatatgacttctctcattctt

SEQ ID NO: 447066 - DNA, 1965 bp, Homo sapiens
tttttttgtggagatggggtctcattgtgttggccaggctggtcttgaactcctggcctcaagctagctacctgccttagtctcccaaaatgctggaattataggcatgagccaccaacaccttgctcagtatcctcatttcttttcctagatacactgtctccttcaatgacacatagggacccatttgcgaaaacgccatcaggaagttttggaagctaccaggtttaaagggagatgtggtagctattccatgcaattcgaggttctataaattaaaataatagtcactgtagtcttttgggggaaacagcataatctaattgagactacatataaatgtattttaagcactcagcctgaagagggatgtagaaataaagactgggaatatccaacgaaaaataaccaaaacagtttatgtgtggctatcagggttgtgccatttaactctaaaggctacgtttattattccaactggtttgcttattctgacaattaagttttgttctttgatacctaataataatcgtaacttccacttactgaatgcccactacataccaggccctgtgttaagcatgttacctgcatcaatgccatttgatctccattgcccaatgggtcagggtattgtttcaattccacagaaaaatgaggcacaagattcaatcagttgtccaagatgcacagctaggaagtggcagggtgaggaggggaaccacagcgggtctggttccacagtccgccagcacctctgtctgttgtgtgccaagccggataacctgtggagggaccacttgcccggacaaggatcaatcagtgccacacaaacaagctgttacttctcactgactcttgaaaatggggactcgaatttatctttgtcttcaaagataaattgtcctttacctgactgcatcatacctcacacagtgctatcaaggagtggagataaccaagtgggttatttaggtaatttaggattcctggtcctccttaggaacatctctgtttaacacttctctctcccctcacaatctctccctcccactctctcaaagaggattagaggtaaaacaaaccaatcaggggttatatatccaaataaacatgatccccttctaagtagtcctggtaggctgtaaactcttccaatggtactgccgctgctgcacagctttggaattttcctcttgcgatggcgtccagggccaattttgaaacgtgcaaagaagatggttactatttcacagttacaccttggtttagatcggcttcgctacttatttttctcagctatggcccctatcttatccgtcagattcagtttgaaatgacttttggcctctttcagaaacaaagtctctgcaagaatacaaagatttacttctgccatcaccgtcaactacgtcagggacctggagccctttgctggatgcagctggtccttccatggggctgcttacctcatgggatgctcagacaaacatcttcttttcttttgggattcagatatgagcaatattatcttgcatcacatatgattacaataaaaatatacaatgtctttcagcagtagagtctggaaaattcagtgtgggttccctcctgcctattttccctcaattctggttcatatcacaagaggaggaagaagcggcaaggccttgaaatgttaattcctttccggttaacttcttcaactgtttaaacttcattatcttacctcttttcaagataagaaaagaagacttaacaggctgttaaggctggactttgtttttactcctgagctattttaattatgccataaaactaattaacagctagggaaaatctagaactgtgttattttcttcctctacaaagatccaatttagtattccaggagtcactgagatggtggcacagccctgctctgaaactgaccatgatgtaggatatacatgagcctctggaaaa

SEQ ID NO: 447067 - DNA, 321 bp, Homo sapiens
ctcacaatctctccctcccactctctcaaagaggattagaggagaatgttccaaggaaaccatgaggtatgacactaacataataacgtttatttttaaaacaaaccaatcaggggttatatatccaaataaacatgatccccttctaagtagtcctggtaggctgtaaactcttccaatggtactgccgctgctgcacagctttggaattttcctcttgcgatggcgtccagggccaattttgaaacgtgcaaagaagatggttactatttcacagttacaccttggtttagatcggcttcgctacttatttttctcagc

SEQ ID NO: 447068 - DNA, 1917 bp, Homo sapiens
acgtgttgtgggagggatccagggggaggtaattgaatcatgggggctggtctttcctatgcgattctcatgatagtgaataagtcttacaagatctgatgggcttatcaggggtttccgctttgctccttcctcattttcccttgctgccgccatgcaagaagtgccttttgcctcctgccatgattctgaggcctccccagccatgtggaactgatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447069 - DNA, 2822 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaatacatgtttgagagccttatatttgggagttttgtgttgtattttttttttccttacagtgctagattctttcccttaattccacacagaacccatcgctacaatatgtgagcagatgaaaccctgattagtcccagaatgctacgaaggggaagaggaggacgtttattagagtatgctgagctgctgtggaatgacagaaaaacaaagtctctgcaagaatacaaagatttacttctgccatcaccgtcaactacgtcagggacctggagccctttgctggatgcagctggtccttccatggggctgcttacctcatgggatgctcagacaaacatcttcttttcttttgggattcagatatgagcaatattatcttgcatcacatatgattacaataaaaatatacaatgtctttcagcagtagagtctggaaaattcagtgtgggttccctcctgcctattttccctcaattctggttcatatcacaagaggaggaagaagcggcaaggccttgaaatgttaattcctttccggttaacttcttcaactgtttaaacttcattatcttacctcttttcaagataagaaaagaagacttaacaggctgttaaggctggactttgtttttactcctgagctattttaattatgccataaaactaattaacagctagggaaaatctagaactgtgttattttcttcctctacaaagatccaatttagtattccaggagtcactgagatggtggcacagccctgctctgaaactgaccatgatgtaggatatacatgagcctctggaaaa

SEQ ID NO: 447070 - DNA, 2088 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447071 - DNA, 4776 bp, Homo sapiens
  misc_feature (1282)..(1282): n is a, c, g, or t
  misc_feature (1326)..(1326): n is a, c, g, or t
  misc_feature (1967)..(1967): n is a, c, g, or t
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaacnctagtgttgatttgtactttttctgtttttcttaccttgtgaantatttatgagctaaaattttgggaaaaagcataacctaaatctccatcatctcttacatgtttaagaacatatccatttatcataaataaaattccttatggatcttatatatctatgattgtcagtaactgaataggaaagatttacggtaaacactttttatttcttatgaatgtagaacccgaggtagtagttataggtagaacataaattgacagtgatgttttaagaacatgcattcattcagcaaatatttagtgaaggcctactctgtaccaggccatgatctgggcacttgggatactttagtgaacaaagcagacaaagataatgcaccttcaaggggcttgccttaaaaaaaaaattgttagatttaaatatacatgatattgagtatctcttatgatggccgcaaatgagccttgaattctggttctatccctgttattttcagggatatccttggaagttacttactctcttttgcttacattgaaaaactaggataaaaatatttgttctatttacctcacagtaaatagattaatatatgtatgattttggctaagttactatcaattagccgttaaaatggagggattgaatttgctgatctgttaggtctttgttatggtaaatntttatgatacttgctaattaggggggaaccaaatgaaagagcatcacatggatgagtatggatgatgatacttattttggaaatttaagaggaatgggcaaggaaaacctaagagtagaagcaagtgtcttatttcttagctccctgcctgctaacttggagcttttattctttcctttggtgaataattctttaaaaattttatatttaaatatggataaatcaagtgatgccagccagtctgaaataaaaaatcaagagattaactgggtagctagccctcttattttcaggaagaacttaagttatatgtgtccaagatcacacagggggatggttagttacagagctggatctcttaattcccaggcaattatacttttaatgatgctggtttttggtatgtgattttatttagaagttagaaaaaattttaaacatgattggaagcagaaatactgaacatggtagccctctaaagaagggaacataaatattgctcataagccaggaattactggcaggcctcagcttctcagatcaagaacaaatacttcattggtcaaactaaagtcatcataattccagcatcgagatgtctttataggttgtcacagtttggaatctctggacatatttgggtccaaagctccttttctttccaaaagaagagccctgtggagacagtcacagtgtttatggatatatagtcttcctgataaaagctattaggggattttgggtgcaataataatagttaataaaaatttaaataatttgagtagtgttagttacagttaatacatagcatgtactatgtgccaggcactatgatatgacctttatatctgaattagtagcttagtcctcataacaaacctttgagattaaatctaattattattctcatttcacagatgaagagcttggtgcaaaagtggttaagtagcttgctcagcgtcacacaattaggaagtggcagagccagggtttaaacccaggaaggctgatttgacagttacactattttgccttgtcgtattggtggggaaaaacagtgaaatatttttaccaggatgctttggagaaaatttgagttggcaatctctgttaaagtataatatttgtgagtttatctcaacctgaatggtctagcttaaaaaagaaaaacgttatactaggtggctgctttttctattttagtttttacttagaagataaatttgtcaaattagaatgaggctaattctcccaggtttctccctagtgcagaggaggcaacagccaggcagatgcccgatgctgcttcatggaagtctgttcttcatttgggtcttttctttgaaagtttctaaggagtctgacaggatacgcttgttggagggtatagctgtccatttctttaagagtttctctagtttgcttgatctgcagcactgaggttttcttgctgcacagagttcattgaggtgcacattatagtaacccactttccggtattattacagagcgaaggctccttgtaaataacccagttcctctttttttgtctccactgtttggaaattttaaatcagggaagcaactctcaggtaagtgggatattcttaccgaaaataaattcttgtggacttactccactaaaataaattattgggcctttattgttgtatccccttatcaggaaaatcacctataatttgtatgagtcagttatatcctataattaaggaagattaaggccacaatgattgaaattaaataatatttttgatctaaatttttaattgttgtcttttttcccctcttctattttgcagttcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447072 - DNA, 2091 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaaagcgaaggctccttgtaaataacccagttcctctttttttgtctccactgtttggaaattttaaatcagggaagcaactctcagttcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447073 - DNA, 1965 bp, Homo sapiens
ggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccggggcgggtgggggcgccgacggtttcccggccctggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacattctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaataagttttgattttcaaatgttctgcttcatgtgtctgtgaagaattgtacttttaaaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 447074 - DNA, 2189 bp, Homo sapiens
  misc_feature (598)..(598): n is a, c, g, or t
  misc_feature (1125)..(1126): n is a, c, g, or t
  misc_feature (1334)..(1334): n is a, c, g, or t
  misc_feature (1468)..(1468): n is a, c, g, or t
  misc_feature (1821)..(1821): n is a, c, g, or t
tacctagggaggttaaggggcctggccaatgactcgttatttgaagaaggatggagatgagagtttgtttccctagtctcagtcaaatgcccttaccatttgaccctcttgcctccctgtaatgctgttgggtaataaggtcaggtaactgcattggatagagcctgggtgtgttttattgtgaactccctctctttctcctttttgttgtatctgccttagtgcttagcttctttattacaaattagatattaaatcctgttctcacattgagagcgaattctttctccagaaaggataacaaaccttttgtttgagagagatttttcactttttgaaatggtctgtttgtttgaagttacagaagaaaaataagtgtaatgcacagttgtatttattattcatgtgaccctggaaacatttcttccccgccctgtgtttcagtttcttcatctgtaaaatgaggttaataatggttcccccttctaatgttgtttttgaagattacatgagttaatacatgtaaattgcttagaacagtgcctagcactaatataatggaagtgttgcctactgcctattggcagttttctgtacngcttcaccttcccttaggacttcttgtcagcccagttatgtgatttttcacctcgtttttgtttaggagactctactttgttgatgtttttctgagaaacaatgtgctgtctgtttttctctgtttcctttgacatttgctgttcatctttcactgaatatttgtttaagaaagacatacagaatgttaattttcattgattgtagctttcttctttttaaggatttggaatgccctgacagataattatgggaatgtgatgcctgtagactggaagtcatcgcatactaggaccttgcacttgcttactctgaacctctcagaaaaaggggtaagttaggaattgaaccaatagtgtttgaataactgatgctgataatagaactaaaacagtagcatttctgcttaacacagattcactgacctgcctctcatttctgaaattatagcagtttgggtggctctgtcttgatgtcttggctgtagggccatcaccttgctggcacattcctccagttcttctccannacactcattttttatgtgtagctaaatttccatcacaatttttttttttttgacggagtctcactctgttgcccaggctggagtacagtggcttactacaacctctgcctcctgggttcaagcgattctcccacctcaaactcccgagtagctgggattacagcatgagccaccagtcccggctaatttttgtattttcagtagaganagggtttcgctgtgttggccaggctggtctcgaactcctgacctcaggtaattcacctcccagagtgctggattacaggtgtgagccactgcacctggcagtgatgatgcactgaaacactcagtaaaatttgntgcactgaaaccctcagtaaaaatgctagcctttggtttaatatactgagagtattggaatctcaacacggagttaactttttaatgagtgtagtgacctgctagacatgatatgttgtcaggagactgtgtattcctgtgaatactggagaacctttaaaagatattttagttcttggcttttaaaatacggtcttggctaacttacctttcttggggtctcctgtgtacatcctggtattgtaaagtgaagatgtcttgactaagaagtgtgagcacgagtggtgggacaggtagggaggcagaaaagggttgagaattacttgaaatggaaaatcacagtgttaagcttntttaaatctgatgagaaacatatccaaattatctaagtttcagggcctggctgtttaagttccttatcaaataataatgtaaactcatgccagatcttcttgcgtgctctatatttcattaagtgtaattatgtgattattgagaatatagtgcagtaggcctgtcactattttacatagtattgttaatgttttgttaaaaggattttcttacatatgtgatcagaaaagcctactgttattattttctagtaaaatgtagaattctggctgtatttcccagtattcagtagctatggaaatcttcctgactgtgccagtcattaatcccattaagctttgcagactgacctggcatatatttaatg

SEQ ID NO: 447075 - DNA, 205 bp, Homo sapiens
gcagaactgaagtagtatttcttaatgtcagctcccatccagaaacacaaaccatgtcagccttagaactcatgtgaaatggcattggtagttttaatttattcatttcatcacaagcatagattattgtgttatttaaaatgtaaaacaggaagcataggagtcataaatttccttttttctcaatgcatgcctccaaattatt

SEQ ID NO: 447076 - DNA, 7061 bp, Homo sapiens
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgccccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttg

SEQ ID NO: 447077 - DNA, 6817 bp, Homo sapiens
tgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttg

SEQ ID NO: 447078 - DNA, 3758 bp, Homo sapiens
attcattcattttttcttatattctcttttatattcaactttttatttcaattgaaatgtaatatgataaaaatatgagttttttaacaacaaaaaactcaaaggaaatatgtttttagttcatgtgttttgagccctcctcaggggatttgtgttgagtttattacagctatggaaatggaaattatagaagttccatatttaacagccttatgtttttgatcctaaaagtagtttgttttgaaaaggtttgaaaacatacaaaagcacacatatactaaattttttcccattgactggaggaaattgagaaagaattttgctacaaattaaatgtacaaaaaatattgaaagtgggtttgttttaggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttg

SEQ ID NO: 447079 - DNA, 3584 bp, Homo sapiens
tgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtttcagaagcaggcaacaggaacaagatgtgaactgtttctcttctgcagaaaaagaggctcttcctcctcctcccgcgacgagacaggttctcactatgttgcccaggctggacttgaactcctgagctaaagtgatcctctcaccttggcttcccagagtgcagggattacaggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctgcacttccttggcctatccggtatgccgcaacgttattccgattatcctgatgcatacaccgcatgaaatattatctcatccttaggctcatttatctcattagcagcagttatgctaacaatttttataatctgagaagcctttgtttcgaaaagaaaaactataacaattgaacaaccatc

SEQ ID NO: 447080 - DNA, 3600 bp, Homo sapiens
tgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtttcagaagcaggcaacaggaacaagatgtgaactgtttctcttctgcagaaaaagaggctcttcctcctcctcccgcgacgagacaggttctcactatgttgcccaggctggacttgaactcctgagctaaagtgatcctctcaccttggcttcccagagtgcagggattacaggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtaagctgcccattgaaacctattttaaattcaaggtatgtgtttggcatcctgtgtaatataaatgtacaatgtcttaacgatctggacttatgccaatgcccagagggagaggcattctataatgactagagattgtgtttggtgatcatagactataactataggaagtatttggctagttggttaaacattcttttcacctcttgcttaagcttaccaagaaagtatcatttttaaaggaattgtttttgtttacattttctataaaaatatttttgaattcaatgttttttgttcgatatcaatgaggagaaaggaagttttctcatcagtttattttggtttgcctgaagagttatagaaaactgaaacgcaaatagtttcaaagcttttattcattcaaaagtttttgattcaaaaagactatgttcttaacaactatatcacctttaatgtataataaagttttgtcatcttagatttcatatatgtt

SEQ ID NO: 447081 - DNA, 862 bp, Homo sapiens
cagggggactgccagtcatcagacccctcagggtgcacctatgtcctgctgcagaactgaagtagtatttcttaatgtcagctcccatccagaaacacaaaccatgtcagccttagaactcatgtgaaatggcattggtagttttaatttattcatttcatcacaagcatagattattgtgttatttaaaatgtaaaacaggaagcataggagtcataaatttccttttttctcaatgcatgcctccaaattattatactatcatgtatttttcttctttaaatctgttttgggggcttgaacatactaaatgctccagtacttgtggactgatatttgaatatatgtgcgtttaactctaataggaagaaaacacccttattcatgggaatgtatgtgccaaaaatattctgcttatcagagaagaagacaggaagacaggaaatcctcctttcatcaaacttagtgatcctggcattagtattacagttttgccaaaggacagtaagttctagaaggattatatataatgttactaagctttacttgggcagtggtgtaaagggcatgttgttaattttccttgaattccatttaatttgtatgttcctgattaataataaaattatcacttttagcaatttaaattgttagttaaatcttagtctctatttttctttcttataagcatataaccatggactgtgaggtgattttttaaaaacagttttaatctctaattatgtatgaaggataggattttatccatttttagtatgaagttttgtaatattccttgagccacaagtaaattttctaaatattcttttcttctcgtcactaaataaaaatttagcctgag

SEQ ID NO: 447082 - DNA, 5134 bp, Homo sapiens
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgccccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaaggtcgacgcggccgcggtcgacgcggccgcgaattc

SEQ ID NO: 447083 - DNA, 6910 bp, Homo sapiens
tgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtttcagaagcaggcaacaggaacaagatgtgaactgtttctcttctgcagaaaaagaggctcttcctcctcctcccgcgacgagacaggttctcactatgttgcccaggctggacttgaactcctgagctaaagtgatcctctcaccttggcttcccagagtgcagggattacaggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttg

SEQ ID NO: 447084 - DNA, 2905 bp, Homo sapiens
gataatattctttatttctccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacacattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttg

SEQ ID NO: 447085 - DNA, 1167 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447086 - DNA, 1075 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatataaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447087 - DNA, 1326 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccaggctggagtgcagtggcacgatctcggctcactgcaacctctgcctcctgggttcaagcaattctcccacctcagctacttgggaggctgaggctggagaatcgcttgaacccaggaggtgaaggttgcagtgaccagagatgacgccattgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447088 - DNA, 1019 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatataaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447089 - DNA, 988 bp, Homo sapiens
aaaaaaaaaaaaaatcactggcctcattttataaggaagacattgagtcccagggtgaggggttatagataggactttctcaagattgcacaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatataaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447090 - DNA, 1874 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccaggctggagtgcagtggcacgatctcggctcactgcaacctctgcctcctgggttcaagcaattctcccacctcagcctcctgagtagctgggattacaggcacatgccaccatgctcagctaatttttgtatttttagtagaaatggggattcaccatgttggtcaggctattctcgaactcctgacctcgtgatccacccaccttggcctcccaaagtgctgggattacaggcatgagccaccacgcctggccaaaaaaatatgttttaaatgtcccatttcaccattgccaggcaggcattcttccttcagggagaggatggtgagaattaattggttctttgcactgttctcctcatgtggcgatttcactttcatgacagcctttctatattaaaggctcaggatgtcacggagaatctatctaatcccactgtattaagaggggaaaccgggccaagcgcagtggctcacacctctaatcccagcactttgggaggctgaggtaggtggatcacccaaggtcaggagtttgagaccagcctggccaaatggtgaaaccccatctctacgaaaaatacaaaatttagccgggcatggtagcaggcgcttgtaatcccagctacttgggaggctgaggctggagaatcgcttgaacccaggaggtgaaggttgcagtgaccagagatgacgccattgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447091 - DNA, 1113 bp, Homo sapiens
ggagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447092 - DNA, 1039 bp, Homo sapiens
  misc_feature (163)..(163): n is a, c, g, or t
gtggtcgctaggcttgttttccttagtgagcatcctggtcctatgactagtgcttggtgttcttctaactaactaggaatacgcgcggaaggacaactcgagcgttctgaacagattatccctagatggagttctgaggtctgttagcgtgtgatgtctattncaagctaggtaggttcgctaacatgtcgagcttcgatatcaatagttagcgcccctgcccacgtgaacatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatataaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaaaaaaa

SEQ ID NO: 447093 - DNA, 428 bp, Homo sapiens
aaatggaatactttcaaaccttcattagtatcaaatatatatacatacacaaacatatatatgtatgtacatatatttattttgtttgtttttttcccccgagacagggtcactcaggctggattgcagtggtgtgatcttagctccctgcagccttgaactcctgggctcaaaggatcgtcctccttagcctcctgagtagctgggattacaggcgtgtgacaccatacctggctaatttttaaattttttttgtagagacatcatctcattatgttgcccagactgatcttgaacttctggactcaagcaatcctcctgccttggcctctcgaagtgttgtgaaggttaaatgagttaatacataaagtgatctgaatgctgcctgacacaaagaaagcactcaataaatagtaacttttaaagtt

SEQ ID NO: 447094 - DNA, 2147 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaatttgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgaca

SEQ ID NO: 447095 - DNA, 2403 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttttcgagaccagcctgaccaacatggagaaaccccgtttctactaaaaatacacagttgggctggggtggtggctcatgcctataataccagcactttgggaggctgaggcgggcagatcacctgaggttgggagttcaagaccaacctgaccaacatggagaaaccccgtctctcctaaaaatacaaaagtagccgggcatggtggtgcatacctgtaatcccagctactcgggaggttgaagcaagagaatcacttgaactcaggaggcggaggttgcagtgagccaagattgcaccattgccctccagcctgagcaacaagagtgaaactccgtctcaaaaaaatatccctaaacaacacattaattttatatccttttgaaactttatgtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaatttgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgaca

SEQ ID NO: 447096 - DNA, 1345 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctaagacatcatctcattatgttgcccagactgatcttgaacttctggactcaagcaatcctcctgccttggcctctcgaagtgttgtgaaggttaaatgagttaatacataaagtgatctgaatgctgcctgacacaaagaaagcactcaataaatagtaacttttaaagtt

SEQ ID NO: 447097 - DNA, 1224 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttttcgagaccagcctgaccaacatggagaaaccccgtttctactaaaaatacacagttgggctggggtggtggctcatgcctataataccagcactttgggaggctgaggcgggcagatcacctgaggttgggagttcaagaccaacctgaccaacatggagaaaccccgtctctcctaaaaatacaaaagtagccgggcatggtggtgcatacctgtaatcccagctactcgggaggttgaagcaagagaatcacttgaactcaggaggcggaggttgcagtgagccaagattgcaccattgccctccagcctgagcaacaagagtgaaactccgtctcaaaaaaatatccctaaacaacacattaattttatatccttttgaaactttatgtaagtggaaagtttatataagaatgtgtgcatgtgtttatttttttccttgtgctacttgcattttttttttaagctcaacattcttgagtttcatctgtgtttagaatgacagtatcctattgtacagcaatacccttaatttattcattctcccgttcgtggccattgtggctgttattttgctattacacagtgctaccatgaatatt

SEQ ID NO: 447098 - DNA, 1284 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggaagagcagatgcacacttagggagcagctctgtggccctccctaaggaagcgagtg

SEQ ID NO: 447099 - DNA, 570 bp, Homo sapiens
cctctgcctcccaggctcaagtgatcctcccacctcagcagctgggactacagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaa

SEQ ID NO: 447100 - DNA, 1757 bp, Homo sapiens
  misc_feature (14)..(14): n is a, c, g, or t
  misc_feature (59)..(59): n is a, c, g, or t
tccgtgtcttcagnaccccccacattggctgacagtgcctgtccagcccctctgcctgntgcggtggagacggcttcgggccaggcggggctcctgctgtctcaggctttggtgtggaggggaggggcagcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaatttgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgaca

SEQ ID NO: 447101 - DNA, 1273 bp, Homo sapiens
agtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggcagcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaa

SEQ ID NO: 447102 - DNA, 4730 bp, Homo sapiens
gaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 447103 - DNA, 1005 bp, Homo sapiens
gaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcaggtaagtgaatggcttttgacaatgtattaaaatgcaagtcatgcgtagggtaatgagtccactcttcctgaaaatgaatttaaataaacataatgttattcatgtccattgtcttctgcggtagcaaataatcataaagcagaataatagaattttgatgatgggaaagaaccattgctgtctctagtcttcatgggatagagtacacagggggcagtgggccgctgtgtttaaacacaggtatttttcattaccttcacactcagccaactagaatattgcttttttcccttacctcaggtcctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaa

SEQ ID NO: 447104 - DNA, 1092 bp, Homo sapiens
gaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcaggtaagtgaatggcttttgacaatgtattaaaatgcaagtcatgcgtagggtaatgagtccactcttcctgaaaatgaatttaaataaacataatgttattcatgtccattgtcttctgcggtagcaaataatcataaagcagaataatagaattttgatgatgggaaagaaccattgctgtctctagtcttcatgggatagagtacacagggggcagtgggccgctgtgtttaaacacaggtatttttcattaccttcacactcagccaactagaatattgcttttttcccttacctcaggtcctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaa

SEQ ID NO: 447105 - DNA, 1965 bp, Homo sapiens
gaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcctgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagagtttaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtatacacatgatttctatgttgatagtactatattattctacaataaatggaaattataaagccttcttgtcagaagtgctgctcctaaatc

SEQ ID NO: 447106 - DNA, 1350 bp, Homo sapiens
tgtttattcacataggaacctccaaacatatagaagtaaagacacagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcctgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagagtttaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtatacacatgatttctatgttgatagtactatattattctacaataaatggaaattataaagccttcttgtcagaagtgctgctcctaaatc

SEQ ID NO: 447107 - DNA, 1308 bp, Homo sapiens
tgtttattcacataggaacctccaaacatatagaagtaaagacacagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaatataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcctgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagagtttaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtatacacatgatttctatgttgatagtactatattattctacaataaatggaaattataaagccttcttgtcagaagtgctgctcctaaatc

SEQ ID NO: 447108 - DNA, 450 bp, Homo sapiens
ctgccgggatccaggtctccggggtccgctttggccagaggcgcggaaggaagcagtgcccggcgacactgcacccatcccggctgcttttgctgcgccctctcagcttcccaagaaaggtgagtctcgcgccgccgtgagggctcagaagtcaccaagccgcagaatctcagggtagacggattcttagagatcctatcgttaaaccctcctactttacagaagaggaaactgaggcacagaacgaggcagcggctgggataggtcatactgctagttaggactggagcccggattcgaacccaaacgttcagagacccatctttgctttgcagggatttaagtaacgcggttgtgggacgtctgctcgttgccgcccccatcctcagccctttgaggggtctacccttgttttcctcctcaccgccccctccccgctaccaccccccg

SEQ ID NO: 447109 - DNA, 589 bp, Homo sapiens
gaagactgccgggatccaggtctccggggtccgctttggccagaggcgcggaaggaagcagtgcccggcgacactgcacccatcccggctgcttttgctgcgccctctcagcttcccaagaaaggaaaccgaggctcatagagttacgtagcatggcctatgtattagtctgtgttcatgctgctgataaagacagacccaagactgggcagtttgcaaaagaaagaggttcattggacttatagttccacatggctggggaggcctgacaatcatggcggaagtcaaggaggagcaagtcacatcttacgtggatggcagcaggccaaaaaagagaacttgtgcagagaaactctcattttgaaaactatctgatcttgtgagacccattcactatcacgagaatagcatgggacagacctaccccacatgattcaatcatctcccactgggtccctcccacaacatgtgggaattatgggagctacaagatgagatttgggtggggacacagagccaaaccatatcagcctgtgtaacagcacaaagcaagacatgatgctgagactcatctacgcattttattcta

SEQ ID NO: 447110 - DNA, 2001 bp, Homo sapiens
  misc_feature (99)..(99): n is a, c, g, or t
  misc_feature (128)..(128): n is a, c, g, or t
  misc_feature (136)..(136): n is a, c, g, or t
  misc_feature (171)..(171): n is a, c, g, or t
  misc_feature (184)..(184): n is a, c, g, or t
  misc_feature (211)..(211): n is a, c, g, or t
  misc_feature (262)..(262): n is a, c, g, or t
  misc_feature (275)..(275): n is a, c, g, or t
  misc_feature (340)..(340): n is a, c, g, or t
  misc_feature (353)..(353): n is a, c, g, or t
  misc_feature (362)..(363): n is a, c, g, or t
  misc_feature (379)..(379): n is a, c, g, or t
  misc_feature (385)..(385): n is a, c, g, or t
gaagactgccgggatccaggtctccggggtccgctttggccagaggcgcggaaggaagcagtgcccggcgacactgcacccatcccggctgcttttggnggggggtgtgagggttcgcgcgcaggaanggggtggnggttcgtgtggtgtgtaggtgaggtgtgtaggttntagtggaagtggnggaaaggtgagtgggtgaggaaggggngggagtgaggtggggaggtaggaggagggagtgaggggaaagtggagaggngtttgagaggagngaggggagggggggagtgaaggtggggaggtgtttgaaggagttgttgaaattgaagtagggganaggggattgaggnggggttagnntgatgtggtattggantagggngggggggggggttgaggagggaattaagttgggggtgggggagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcctgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagagtttaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtatacacatgatttctatgttgatagtactatattattctacaataaatggaaattataaagccttcttgtcagaagtgctgctcctaaatc

SEQ ID NO: 447111 - DNA, 2569 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaactttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaaaaaaa

SEQ ID NO: 447112 - DNA, 4664 bp, Homo sapiens
ggaccgcacaggcaaagaggcgcggggctggggttagcctggggcagaaggcgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447113 - DNA, 670 bp, Homo sapiens
  misc_feature (28)..(28): n is a, c, g, or t
  misc_feature (32)..(32): n is a, c, g, or t
aaacttcggctaggtacgaggctgggtngttnagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcgtggtagagggtgaacacagtggggcatacacagtgtggcgtgaaagagtgtgcgtgttttaattaaacaagaagtttaaaatt

SEQ ID NO: 447114 - DNA, 322 bp, Homo sapiens
ccacccgcctcgaattgcatgcccgccgcacgaaccaaaatggggggggaggggggcaattgctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaaaaaaa

SEQ ID NO: 447115 - DNA, 368 bp, Homo sapiens
ttcctttttgtaaactttttattggaaacagctaccaacttacaagtaagttgcaaaaattaaaatggtaccaaaaacagctacataacctcacccagatctacgtttgggaaggttttatttatctcatttgctttatcatttgccccttccctatccctgtatactagatacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447116 - DNA, 3387 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447117 - DNA, 2858 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggatagctccgggctgtcaacacgctgccttccccttccgctccttacccccatgccccacagcctcgcgggcc

SEQ ID NO: 447118 - DNA, 3334 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447119 - DNA, 4906 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447120 - DNA, 3432 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447121 - DNA, 2321 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattacca

SEQ ID NO: 447122 - DNA, 2742 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccaaaaaaaaagaaacaaaaaaaaaaaaaaaaaaaaaaaaaaaaaaaaaggggggggcgcgcgtccaaaaaatctctcccgagggggcgcccaattggggggctccccgggttttttgtgccaacgacgggggccccacaattagagggaggcgacacatatattaacacgaccagaaggaccacgggcaacgcgcaacgttataacaaacaaaagacggcggcacgagcggggaaaacaaagcggaacactcgaggggacactctggggaaaaagaggcaccccctataacaactcgcgggggggaggggagcaacatctttgggcggcaccagaagttcaccctacacacgacataactaaaaaggccccctagaggggggcacaatatcaaagcattgtacacacacggcacaaagcgtac

SEQ ID NO: 447123 - DNA, 1948 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaagctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacctataatcccagcactttgggaagccaaggcaggaggaacacttgaggtcaggagtccaagaccagcctggcctatatggcgaaaccccgtctctgcttaaaaaaa

SEQ ID NO: 447124 - DNA, 2630 bp, Homo sapiens
ccaagcgacaggtccagaatcaatcaaccaatcgattgcccaaagcaagatgccatttttccggaaggaaggttggaagctttaaacaaaaaggtattcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447125 - DNA, 3335 bp, Homo sapiens
aacgggtgatgcggttgaagaaagcctaggtctcttagatgattacctggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447126 - DNA, 679 bp, Homo sapiens
  misc_feature (28)..(28): n is a, c, g, or t
  misc_feature (32)..(32): n is a, c, g, or t
aaacttcggctaggtacgaggctgggtngttnagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447127 - DNA, 2614 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgctttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaaaaaaa

SEQ ID NO: 447128 - DNA, 2034 bp, Homo sapiens
ggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447129 - DNA, 3436 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctccgcgcgcgaagagagcccagggaacaacacattgcgggcatacacagtggtggctgaacatagagagcaggaaacaacacaacaccacgaggctcaacaaacaacacaaacaaaaaaccccaggcaacaagccgggggaaaa

SEQ ID NO: 447130 - DNA, 4697 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447131 - DNA, 4652 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaatttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447132 - DNA, 4506 bp, Homo sapiens
gcctggtggcgaattcggcacgaggagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatgtaggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcctggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccggagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaaaaaat

SEQ ID NO: 447133 - DNA, 2041 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaagtaagtagcaggctgctctggggtggtgccttctctttcctcctgctcatcctcccagggcaggacgtggcacctgaaggggctgaggactggtgaccagaggtgagctgtgggctgtcagactggttgaggtacctataactggtcccagcatccctgtggcacctttggattccctgagcttggggagttgagagtagcagaggggtgtggtcccagaggcccagcccatctgtccagcttgctcaggaaagccctgcaaactcaaggtccataggaaaggaagggaaaagaggaaaagcaaaggagagtgagagagcagaagggaagaaaaaaattagaggtgcagcaatataagagaggaacaaggccgggcacggtggctcacacctataatcccagcactttgggaagccaaggcaggaggaacacttgaggtcaggagtccaagaccagcctggcctatatggcgaaaccccgtctctgcttaaaaaaa

SEQ ID NO: 447134 - DNA, 2386 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtaatccatggctgtgtactgaatagtattccccgctacagctggactggactccatttagccttttaagccgagctttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaaaaaaa

SEQ ID NO: 447135 - DNA, 2400 bp, Homo sapiens
gaagaactggaactgggctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaactttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaaaaaaa

SEQ ID NO: 447136 - DNA, 760 bp, Homo sapiens
agctggtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagctttgataaaattgttggcttttggctgggtgcgatagctcacacctgtaatcctaacattttgggaagccgaggcaggaagatcgcttgagcctaggagttcgagaccagcctggacaacacagtgagaccttgactcaactttaaaaaacaaaatgttgactttgttatcagtacattagttatatttactgtgctacaagtagagtgaaacttttaatttgctgccaaacaagccaagcaggcacctgcctcaggcctttagcagtagctatttcttcagcctgggaagttctccactccaccccttagatatccccagggctcactcccttgcctccttcaggtctgagtccagatgtcaca

SEQ ID NO: 447137 - DNA, 5324 bp, Homo sapiens
tggcgcagggccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447138 - DNA, 5216 bp, Homo sapiens
tgaattcatcatcagaggaggaagagttcccagtcattgtcttcacttctccagaagtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447139 - DNA, 5469 bp, Homo sapiens
tggcgcagggccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtattcgctacatttatgctgatcctctccattgcaacatgacatacctgtttatcaggttattgaaggatgatttaaaagagtatacatatgcagcacgcctctcaggtttgagctatggcattgcatcaggaatgaatgcaatacttctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447140 - DNA, 3912 bp, Homo sapiens
agctggtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447141 - DNA, 4036 bp, Homo sapiens
agctggtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagctttgataaaattgttggcttttggctgggtgcgatagctcacacctgtaatcctaacattttgggaagccgaggcaggaagatcgcttgagcctaggagttcgagaccagcctggacaacacacccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447142 - DNA, 3323 bp, Homo sapiens
tgactagagtgtacgcccaagtagagattgatcaaaaaagtatgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447143 - DNA, 2974 bp, Homo sapiens
tacaggcacgagacactgtgcccggccagaagaaacttgttcattgggaactaaaagtgatgaactaaaagtttcaggtcaccaggtgttggagcttctactttagttcttccctgaacatctagtcactcagcctctacccttgtctgcctttgcctcctgtttgaacagttgtgttattttgcaatggatcatttctggccacatctgttcccagcactgaatactggagagagacttcttagtctctcccatgttacctgcgtattttaatcatctagaaggattgacattagcttgcaagaggaggaaactggcagtgtaactaggctttttgtgggtgggcacaccagcctctgctactctgctgaagccttgatgcgaagcctctaagtccttggtgagccagcccttgtttgcccagaggaaaaccaaaaggactaaggacacttaccataggtttgtacagaccaattcacgaccctccagacatactgatccagaagaaaggtcagcagatcaagatacatgggttattaggtagagcggcctcaagccaaaacaaaaaaacagtatattaagtagaactgaggtatgctcccagtgtccgccaaaaaaagttgatgtccttattctgatgtttaggttaaatacactaaaaggaaacttttttctttgcagcctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447144 - DNA, 2345 bp, Homo sapiens
tatacataatttatatacatattcgttatatataaaccactttagcctgttgcctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447145 - DNA, 2357 bp, Homo sapiens
cttcgacggcacacgttactctgttctcggcggtgtaatcatgcaatcgtttgtacgtcagcctcctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447146 - DNA, 415 bp, Homo sapiens
caaaagtgcactcttctatatctacatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447147 - DNA, 400 bp, Homo sapiens
gaggcctgcagtgagccaaaatcacgctactgcatacaagcctcggtgacaaactgagaccctgtctcaaaaaaacaaaaacaaaaccagcaaaaaaaactctattctagttctgcatacaggccaacacatggtctaacccaccctatctcaaatccctatccatgtgctctttcagatacaaatatggctccatgaaaacaattttgttagcatttctcagaaagaatgaggggtaagagggaggaaaggaatgactgcaccctgtagagtggctataaaaggtttccttcagcatttagaaaaatctgatgatgtattatatgggtttacttgacgttattgtttgtccttaaatataaagtcacaaatcaacaattaaaaatctctttcttttcag

SEQ ID NO: 447148 - DNA, 784 bp, Homo sapiens
ttcaccacatggacctctctgtagagttgcttgacatggcagcaggcttcccccaaagtgagtgatccaggagggaaagtgagtgatcaggatgcaagccgcggtgtcttttataatgcagtctcagaggtataccattaattctgtcatattttgttagtaaggcagaccaaccctggtgtagtgtgggaggggaccacccaaggctgtgaatctcagcaggcaaggattgttgtgggccaccctggaagctggctgccatacgcttgcaagggacttctgcctctgccttcctcctagtgtccagaaagacgaagacaggacagttggtattggcttctctgatctgtctcttccttcactgtacccccatctccctaatacaggggaaatagaaggcagatttcactctgctacaggagtctgcagtctttgtctccagcttcctacctgctgactcttgagtatgcttcaaggcccatgggacagcaactccagaacaaaactctaactattgcttctgtcctcctcctcttgaagagtgatttgattgaacatttttgctgaatgcgcctctatttccctaaccaaattgtttctccatcacaggatacagctatgagcaaactttggttcaaacaagatgataagttttttttgccgaaggcttgtctcaactttgaatttttcaggtatgtaagatgaatctagcttataaagcttataaaaatcaacaattacgtttccaggagttgtctgttcttcttaaacatccatgtctaga

SEQ ID NO: 447149 - DNA, 1107 bp, Homo sapiens
agctggtagtaggtcagtgatacatggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatggtgagactttcgacttaaagcttaatgctttcttcatttttttcctaaattcattttggtttattctgatattgactgtttatacttttaaataacttgtagttctattaaagctggctgtgtatatgttttataaaaacagtggtgggcaggatggctatagttaacagtaacatatacttttaaataggtagaaggaagatattgaacattcccaacccaaacaaatgataaataaacttgagatgatggatatgcttagtaccctgatgtgatcactatacattatatgtatatataataacattatatactctatgaatatctacaattatt

SEQ ID NO: 447150 - DNA, 5909 bp, Homo sapiens
tggcgcagggccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttcacctctggagtctgcatttgtattatttttccagttttagtgaaatagtacagtggccagtcctcagcctacctctcaacatcccagtttgaccagatttcttgctttcattgttcataatgcagaaagcagtgaattatattaacattttaaaagtgtttctgggtaacaatgatttttgtcaaatagaagactcaatttcacaaccttaagaatagatcacttttgtaaaacaagaatctcagtatttgatgttggactccttgctgtgagtattgtcactgactccaaacccagaaagatttgttcctgcccttacagggatgaaaataaaaaggatagaaaaaatatttctctcctctacaatgagtccttacatcttcttgccacatctccagctgcagtttaggcagatatcttgttcaatctctgtcttcttgatccctgtcaaaataatttttctactcatatagtggccagttggctcaggcaggcatttcaagaggaatctgcttgttcctcacttttccagcataggacagtggtccagcccgcacagtcagcattgttctcagggacgatgtgg

SEQ ID NO: 447151 - DNA, 5720 bp, Homo sapiens
tggcgcagggccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtgggaactaccaggttgtttttcaaagcagcggcactattttgcatttccaccagcagtgtgtgaaaattccaatttctctatatccttgacaacacttgctatatgtacttttgttataagccatcctggtgggtatgaagtggtgtctcattggaattttgactttcattttcctgatgaccattgtaagagttttaaaatatattctctaggccgggcgtgttggctcatgcctgtaatcccagcactttgggaggatgaggcaggtggatcacctgcagtcaggagttcaggaccagcctgaccaacaagctcctgcatgtggcatctgaaagctatctgtgaagaggttcaagcaattcttctgcctcagcctcccgagtagctgggattacagtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447152 - DNA, 4132 bp, Homo sapiens
atttttccctagttttggctgctgttatatgatagaaattatcaattattttactgacagttctctagctttactgttttggggaaaactcagggataagctaacattttcacaggtctcaatttttctaagttcatgtaattaccacagacacatttcccagtcctttattcctgtccaccaaggatgtgactttattggagagagagggaagacatgcaaatgctgtatctgttctgtcggccgtgctcctcccattagcctaagcacagccatgcattttggcccgttcccactgctcacataccctgcatttctaacttgtcagttctgccacaccatctggggtaggcagttccttctccttcttcactactaccagtgcgcacgcacacacgcacgcatgcacacacacacacacacactcacacacacttcaggcttctttttcagacatcttcttttttttcctcataagaaatagcctcaagaattcaaccatatcctcaggaaatcatattaaccggtgttcaatatcttgatccatctcaaaaggccatatcacattgagaagtaataaaatcagctattttactgtcaacattttcttccagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447153 - DNA, 4277 bp, Homo sapiens
atttttccctagttttggctgctgttatatgatagaaattatcaattattttactgacagttctctagctttactgttttggggaaaactcagggataagctaacattttcacaggtctcaatttttctaagttcatgtaattaccacagacacatttcccagtcctttattcctgtccaccaaggatgtgactttattggagagagagggaagacatgcaaatgctgtatctgttctgtcggccgtgctcctcccattagcctaagcacagccatgcattttggcccgttcccactgctcacataccctgcatttctaacttgtcagttctgccacaccatctggggtaggcagttccttctccttcttcactactaccagtgcgcacgcacacacgcacgcatgcacacacacacacacacactcacacacacttcaggcttctttttcagacatcttcttttttttcctcataagaaatagcctcaagaattcaaccatatcctcaggaaatcatattaaccggtgttcaatatcttgatccatctcaaaaggccatatcacattgagaagtaataaaatcagctattttactgtcaacattttcttccagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtattcgctacatttatgctgatcctctccattgcaacatgacatacctgtttatcaggttattgaaggatgatttaaaagagtatacatatgcagcacgcctctcaggtttgagctatggcattgcatcaggaatgaatgcaatacttctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatcttatagatgtagaatattttttaaatacatgcctcttaaatattttaaaatttttcttttgattactgagagaaatttccccaatataacaatgcttaaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatcagaaggtgtgtgaaatcatcacttccttctggttttatgtatttgtagactatgcagcttttcattaaactgcaagtatatacaagacagatctgaaattaggcctgagtgttccgatccaccactgtactagtaaataaaaatccacctaccttttatgtggaaaattatgtgctattgagtaacttttagctcttttttaaaaaatgggtgaaatttaagtgtcttttttatgagaatgacacatgaagagatctgagagcaatctcatgtagtcttccatgaacctgcaattgtttggtatgcgtcagcattttccaatttccaggttggatctagagctgctgttgatcactcaggcatactaatggattcatttagatgggtccaagctgcagtccatgagcaataacagactaccccagatactgcagtttacgcagtgcttagtaaatgagatttgtggaactaagttattagttacctgaggcttcttaagaaagtcttcttttttgaccagttgatgtgaaagagggagcatgtgacacagccagtatggtggagtgctagggttatcctgtttacaataaatcgcctgaatttca

SEQ ID NO: 447154 - DNA, 2519 bp, Homo sapiens
tggcgcagggccggctcgaagcgcaagcaggaagcgtttgcggtgatcccggcgactgcgctggctaatgcggtaccggctagcgtggcttctgcaccccgcactgcccagcaccttccgctcagtcctcggcgcccgcctgccgcctccggagcgcctgtgtggtttccaaaaaaagacttacagcaaaatgaataatccagccatcaagagaataggaaatcacattaccaagtctcctgaagacaagcgagaatatcgagggctagagctggccaatggtatcaaagtacttcttatcagtgatcccaccacggataagtcatcagcagcacttgatgtgcacataggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtttgcacagttttttctgtgccccttgttcgatgaaagttgcaaagacagagaggtgaatgcagttgattcagaacatgagaagaatgtgatgaatgatgcctggagactctttcaattggaaaaagctacagggaatcctaaacaccccttcagtaaatttgggacaggtaacaaatatactctggagactagaccaaaccaagaaggcattgatgtaagacaagagctactgaaattccattctgcttactattcatccaacttaatggctgtttgtgttttaggtcgagaatctttagatgacttgactaatctggtggtaaagttattttctgaagtagagaacaaaaatgttccattgccagaatttcctgaacaccctttccaagaagaacatcttaaacaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggctgggttaatactcttgttggtgggcagaaggaaggagcccgaggttttatgttttttatcattaatgtggacttgaccgaggaaggattattacatgttgaagatataattttgcacatgtttcaatacattcagaagttacgtgcagaaggacctcaagaatgggttttccaagagtgcaaggacttgaatgctgttgcttttaggtttaaagacaaagagaggccacggggctatacatctaagattgcaggaatattgcattattatcccctagaagaggtgctcacagcggaatatttactggaagaatttagacctgacttaatagagatggttctcgataaactcagaccagaaaatgtccgggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatggtgagactttcgacttaaagcttaatgctttcttcatttttttcctaaattcattttggtttattctgatattgactgtttatacttttaaataacttgtagttctattaaagctggctgtgtatatgttttataaaaacagtggtgggcaggatggctatagttaacagtaacatatacttttaaataggtagaaggaagatattgaacattcccaacccaaacaaatgataaataaacttgagatgatggatatgcttagtaccctgatgtgatcactatacattatatgtatatataataacattatatactctatgaatatctacaattatt

SEQ ID NO: 447155 - DNA, 3087 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 447156 - DNA, 3571 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacataaaaaaaaaaaaaaaaaaaaaaaaaaaaaaaaaaaaaagggggggcgccgtccaaaaatgatactcccccgggggggcccactacgtgacgcgtttacaccacgcttttctcgtggtaaaaagggggccccaaaaagaggagccggtattaaaaacgcaaggcacggggccgccggcttataacaaacggctcgggcaggggaacaccggcctacccgtggggcactccctggggggaagggacccccctaaacttcgcggggggggggggacccatacgtggggcacaaaccataccccctcacgaggagaattttaaaggcaccccaagcgggcgaaacttaatacacattttccaaggcgtggtccaacgcgggtggtcacccccaacgcggcaataatgccgcgccggcatagaaaagtcggcctaagcggggcatgtacttgggcaccatatttttaccgggaccagggaataaacacga

SEQ ID NO: 447157 - DNA, 3118 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacataaaaaaaaaaaagaactagtctcgaggggggg

SEQ ID NO: 447158 - DNA, 3102 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaatactattgttgcatccagtaactacggctgtcagctctgtgtgtgtgaacacacccacgactggtgggagggtttcaccagtggttttcaaaaaaaaaatggggcgccggaaaaaatgggcggaaagattacgaggcacgcgcattattacagg

SEQ ID NO: 447159 - DNA, 1317 bp, Homo sapiens
cgaggattacgaaaccatagaatgcagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 447160 - DNA, 365 bp, Homo sapiens
ggtagatgtcttcaacatatagttcaaataaattagtgtatgtgtactactgaatcctctttcaacctctctgcattccaaataaaatcttagtgcaaacatcaaagtgctggtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 447161 - DNA, 3033 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagttatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 447162 - DNA, 3253 bp, Homo sapiens
  misc_feature (3244)..(3244): n is a, c, g, or t
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacataaaaaaaaaaaaaaaaaaaaaactcggaaatacccagtaaaatgttgaagaaggatggaggatttcttcatatctgacgtttctgaaaccctttgtgtctgctgttgtgtgaagattgacatttaccatgattttccttagttactgcagaacatagngaaaaataa

SEQ ID NO: 447163 - DNA, 3033 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 447164 - DNA, 2721 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447165 - DNA, 924 bp, Homo sapiens
  misc_feature (879)..(879): n is a, c, g, or t
  misc_feature (914)..(914): n is a, c, g, or t
  misc_feature (918)..(918): n is a, c, g, or t
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagaattgcanggcgaaaaaaaaaaatctggctccattgggcgccncaantgggaa

SEQ ID NO: 447166 - DNA, 491 bp, Homo sapiens
caaaatgtaaacaaatgaaggaatactacttctgtttcttggaatgtttatggtattttttgttcaatttaatcacataccctgtgtatttgctcaggtccaagcagctcagtctgaggctaaggttgtatctcagtatcatgagctggtggtccaagctcgggatgactttaaacgagagctggacagtattactccagaagtccttcctgggtggaaaggaatgagtgagtacaactgaagtaatgttttttttttgatgttttaaccactaatcaatgaatctaaacttgcttcatctccattgtagtccacatccctctggcatgcatgcatatctctttttgttacagcgttttattttaaccacagtcattacagatgacacagctgcaacactactcttgtagttttagctgtggtgaacatgagttccagctagtgtttaattccataatccgtgattggttctgttctgatatttgctactc

SEQ ID NO: 447167 - DNA, 403 bp, Homo sapiens
ctgttaacatctgttaaaaatatacaacccctttgacccaacaattcctcttctgaaaactatcccatagatattacactacggtgcttttcatttaaatggacagggatggatgttcattgctttgtttgtagcagcaaagcaaaacaaaacaggaaacaatttgaatgactatagaggagaagttgaccaaattatgggaaatcgttatatgaggatattatgcaactaaacagaatttcttgacctgaaagagaatgtccatgatatagtgttaaataaaaaaagagcaagttacaaggtaatttgtataatataaccctattttggtttgtttaaggaagttccatctccaaataaataaataaaacattgctcatggtaaaaatgacctctgacatgt

SEQ ID NO: 447168 - DNA, 2688 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447169 - DNA, 2903 bp, Homo sapiens
ttcagtgctgaaggtcgacgggcgagaactacagttcccgtcaggacgagcggagcggcggcttgttgcatccttaataaggagccctcaccaacaggctctggaaggccattaggcttctgctcacagtctcttcaaggttcttcagcttctgccgcccccaacaccagtcccaaagtcatgacctcgtgtttatgttttgttgcagtagcacccctcttctagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcggaaacattgtttatgtgtatatacgagagcttttgctcaggagtagaaggatagattccaggctattagcagtggctacctaagagagtggaaagggaaaggagcagtgaagagattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447170 - DNA, 2625 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447171 - DNA, 2634 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447172 - DNA, 1893 bp, Homo sapiens
atcgggcacgagaatcgacggcccctggcgggtgttaaacatcggccgaggattgaaagcgcatggacattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447173 - DNA, 2573 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgaagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447174 - DNA, 2167 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacactgtctggcagaaactctctgaacacagacttacaatcccggcggactcaagacaagcagcacagggcacaactaacacgccgcgacataacatcacacggccaatgccaaacacccagaggaactcgaacaggcgcggcacacagccacggcacgtcgccgaaaagagcaacacaaagagccaccacactcggggacacacgggagatcacacgacacacgagagcaccccgatcgcaaacaaacacccaacaaaaaccgactgcgactaattgcacagagaggaccacaaaagacccaaccggagccgcaagcacgagcacccaccgacgacataagagagacagacacaacaccccgacaccgggggcacctgagcagcgacgctcggaacgactcggaccactaaacagatcacccagcaacagaagcagaacagccacgcacaacgcacgaccgacgacaacaaacccaaccacgagaatacactatacctcaggctgccgaccgcaccacgaacatagaacacacacgtcctgcaccgtacagcc

SEQ ID NO: 447175 - DNA, 1505 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgagtacaactgaagtaatgttttttttttgatgttttaaccactaatcaatgaatctaaacttgcttcatctccattgtagtccacatccctctggcatgcatgcatatctctttttgttacagcgttttattttaaccacagtcattacagatgacacagctgcaacactactcttgtagttttagctgtggtgaacatgagttccagctagtgtttaattccataatccgtgattggttctgttctgatatttgctactc

SEQ ID NO: 447176 - DNA, 768 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcaggtaatttaattatttctatttgttcttttatacatgatacactcatcagaactatttaatgcctaggcaacacgtagacactaagtatacatttacactaggtttaggtcttcagagtttcttaggaaat

SEQ ID NO: 447177 - DNA, 464 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttctttcattacttctgatacactagagatttttagtggacccgactgaatcgatttctttggcaatggaacattataagctgcagg

SEQ ID NO: 447178 - DNA, 464 bp, Homo sapiens
gagtatcacttttttctggaactatttctgttttatttcagaacctgtctgagaaactctctgaacaagaattacaatttcgtcgtctcagtcaagagcaagttgacaactttactctggatataaatactgcctatgccagactcagaggaatcgaacaggctgttcagagtaagcataagctatgtttatcttacagataattttcctcagcataatttatcaaaataattttatagggaaaatggggtacatgtactgacatcaggacataaaaatactaatcactctacttaattgcagtttttgccattaaaagtaatggcaaaatctatataactagaaatttataccttgtatgacaaacacaaaatcaccatttacaaggctatttacccagtatcctttggctatgtcgcatgtgcctgggtggtaagggctaggggtcagtgtggtcccatgct

SEQ ID NO: 447179 - DNA, 287 bp, Homo sapiens
gtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaagagtatcttatcccttttcaaaaagtacagttctggccaggtgcagtagctcacgcctgt

SEQ ID NO: 447180 - DNA, 578 bp, Homo sapiens
gcagaaactggcccgaagggtagcgaggatcgagtgaaagcagaaatagcgtgtaccagtacttcctctcctacctacagtcgctgctcctatttctggtttcatcaatcatggcgacccttagagcccgtttctatgctgttcaaaaactggcccgaagggtagcaatgattgatgaaaccagaaatagcttgtaccagtacttcctctcctacctacagttgctgaggtgggaagtagcgagcagggactgagaggcttgaagaaggaacacgaccagagtaagcgagaacgcaggagaagaactagccaatggaagaacgagaacacgaagaaacgacggacctcggccacgagggggaccatgcaagccccagaaatctggatgtgcaagaatggcgaagaccatgttcgcttaaggagatggacgagtgaggcagagagttatgatgacggtccatagagagctggggtgggcggaagcgaatggtcttgaggtaacacattcgacgtggccagcgataatggggtgactaatatgcagtcgcacttttaaggtatagaaaaaaggagtgaaa

SEQ ID NO: 447181 - DNA, 2738 bp, Homo sapiens
  misc_feature (1)..(1): n is a, c, g, or t
ntaaacttactaaacgtgtcccttacagggctcagcagcacgggcccctgtgcgcttgtgccggacactttctgtgccacagcaagggggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447182 - DNA, 2468 bp, Homo sapiens
tattataagccttgcctggaataatgatggttaaaatgcaggtggatgcagacaagacttctttcttttgttcgttcccaaccattgtccattttgtgtgagtttatgtatgcagtggacagtgcccctgtttgtgtgttattcaaacatgtggcagtacaaatatttgtgtctctaaggagtcagatgtgaagtgggtggtgatggtggtagtaaatttctgtgtgtttctctgttaacccaggaaagtataaataccatgagtaacatatatttatagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447183 - DNA, 2530 bp, Homo sapiens
gatgtgttttccttctttagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcacctacagaagcggctcaaattatttctgcagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggtgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaa

SEQ ID NO: 447184 - DNA, 3000 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaaaaaaaaaaaaaaaaaaaaaaaaatttggggcggcctgggccccaaaagagttttagagaccccaatcgcgtggggggcggcgagggcccccagtagaggtcaagttgcacaaatggggccatagcgtggttcccagagaagacaactcgcgggcgaggcacatcgtggcgtgcgcttccttccaccaaataagaacaagcccccggggggccaccggaccggtttgacaaaaacacgaaggcgggtcgggaggccatacaggggatctcacacggggtccacagcgagtcgaaatcaattcgccggcacgga

SEQ ID NO: 447185 - DNA, 2017 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtccaagcagctcagtctgaggctaaggttgtatctcagtatcatgagctggtggtccaagctcgggatgactttaaacgagagctggacagtattactccagaagtccttcctgggtggaaaggaatgagtgtttcagacttagctgacaagctctctactgatgatctgaactccctcattgctcatgcacatcgtcgtattgatcagctgaacagagagctggcagaacagaaggccaccgaaaagcagcacatcacgttagccttggagaaacaaaagctggaagaaaagcgggcatttgactctgcagtagcaaaagcattagaacatcacagaagtgaaatacaggctgaacaggacagaaagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctcgcccctgagttagcagctcgcccctgagttacccgcagctcgcccctgagttagcagctcgcccctggttagcagctcgccctgagttagca

SEQ ID NO: 447186 - DNA, 1742 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcgattcagtcgggtccactaaaaatctctagtgtatcagaagtaatgaaagaatctaaacagcctgcctcacaactccaaaaacaaaagggagatactccagcttcagcaacagcaggtgataccctgtcggtcccagcccctgcagttcagcctgaggaatctttaaaaactgatcaccctgaaattggtgaaggaaaacccacacctgcactttcagaagaagcatcctcatcttctataagggagcgaccacctgaagaagttgcagctcgccttgcacaacaggaaaaacaagaacaagttaaaattgagtctctagccaagagcttagaagatgctctgaggcaaactgcaagtgtcactctgcaggctattgcagctcagaatgctgcggtccaggctgtcaatgcacactccaacatattgaaagccgccatggacaattctgagattgcaggcgagaagaaatctgctcagtggcgcacagtggagggtgcattgaaggaacgcagaaaggcagtagatgaagctgccgatgcccttctcaaagccaaagaagagttagagaagatgaaaagtgtgattgaaaatgcaaagaaaaaagaggttgctggggccaagcctcatataactgctgcagagggtaaacttcacaacatgatagttgatctggataatgtggtcaaaaaggtatgtttcctaagtcttatagtattttatattttaaaatataatctcttaaaggattttaaggatttaggaaaacagcaaattcctaccatctccccgtcttttctcctgcaaagtgtattcgttgttactgttttaaaaaatttgccttggctgggtgtggtggttcacacctgtaatcccagcactttggcaggccgaggtgggcagataacttgagcccaggagtttgagaccagcctgggcaacatggtgaaactctgtttctacaaaaaatacaaaaataagtggatgtggtggtgtgcgcctgtagtcctagctactcaggagactgaggtgagaggatgacttgggcctgggaggttgaggctgcagtgagctgagatggtgccactgcactctatcctgggtgacagagtgagaccctgtcaaaaaaaaaaaaattttttttttttgccttggacaccaaccaagtggattgttccatattgttgatactttctataatagataacatttttggttatgattattgtcacttatgaaaatgtccattttgtagcagatcttctgcctgcacttatatgatatgtatggagggagggggcatagtaagatgggaaagggcctg

SEQ ID NO: 447187 - DNA, 1161 bp, Homo sapiens
ttccggtgcgccgggcgcggacgcgggcacgcacacacgcaagcacgcctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagctctgggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcggaaacattgtttatgtgtatatacgagagcttttgctcaggagtagaaggatagattccaggctattagcagtggctacctaagagagtggaaagggaaaggagcagtgaagaggcaagttaaagccactgatatatcttggcattattttgcttgttacagtaaacagtcttcatcattcaaaaataatattttaatgaaaatggaaataattctggtttctggtagtgactaagttcagaaccaccctgttgtgtttaagtagtcatgttagggatatctgagtcctactagtctcaatctccaacacatatgggcccttagaacataccggtaccataaaccctaaactactccaatgctaaaataaccgtcccaacaattatatactacatgaatgatttccaaaaaacacataatttgaatcaacacaacacccacagctatattagcatcatccctctactattttaacaaatcaacaagactattagtgttgcccaactttctcgaccctaaaaccccctctaatactaatactgatcgtacctcacaatcaggaagccaagcatttccagtgaacatatcagaaaaaatctactctctatataattcctaaattcttattatacttacggctggtgacgggcagattcgtctcaaaagaaaagagtggttatatgcggtggatggagagaggcggagcgggatgtaatgacgggtgggcttgaattttgtaa

SEQ ID NO: 447188 - DNA, 4825 bp, Homo sapiens
ccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447189 - DNA, 600 bp, Homo sapiens
ccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccg

SEQ ID NO: 447190 - DNA, 4607 bp, Homo sapiens
ccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447191 - DNA, 4208 bp, Homo sapiens
cgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447192 - DNA, 4127 bp, Homo sapiens
cgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagaatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447193 - DNA, 858 bp, Homo sapiens
cgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatacgaaaacacccctgtg

SEQ ID NO: 447194 - DNA, 868 bp, Homo sapiens
ccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaagcgagcaggagacaagtaggtgaatgattggatttccgatgttggaacgttgttttatctgggctcgccgacactcagcgctccatcacctcacacctgccctggctgctttctgacctgcacttcctgaggctctggag

SEQ ID NO: 447195 - DNA, 519 bp, Homo sapiens
ttaggatattttaaaataatgtttaagaaataggttttgtcggtacatgtacagttgatccctggtattaatatttgaaaacaaaataaggtttaatattcttcaacttatattcaggttattccaggatctttggagacccgaggaaagccgtgttgaccaaaagcaagacaaatgactcacagagaaaaaagatggcagaaccaagggcaactaaaggtaaaatgaacagaacccaaataatcttatgctgcctagtcaggaccccttttaaaaaatgtggatatgtaaatattttgtatctttcctatttgattttcatggttccaaacctccacagaccatttctggattctttgctgtacttggatgaattatgttggttctacatgacacccttgacttccctgagataagatgccccattgcccagcactgcctgttcctggccctacagtgtggagattttagaattactgccttctcagttctatagtcttcacagcccctcttttctcc

SEQ ID NO: 447196 - DNA, 955 bp, Homo sapiens
cgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgtcacatctcttcacagtgccaaatgaagacaggtctcggtaatctatgattcttggcacagttcgcctgcaatcgggggccgaccttggatcccgggccggggagccccggctccg

SEQ ID NO: 447197 - DNA, 3526 bp, Homo sapiens
cccactagttacccaccccaaactggatcctacagccaagctccaagtcaatatagccaacagagcagcagctacgggcagcagaatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447198 - DNA, 4118 bp, Homo sapiens
cgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgttt

SEQ ID NO: 447199 - DNA, 6214 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 447200 - DNA, 6310 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaagggggcgtctagagataccccagggcccacataggtccagtttggaaagggcccacgggggataaacaggacggccagtacaggagggaaggaggt

SEQ ID NO: 447201 - DNA, 5322 bp, Homo sapiens
cgactgcgggagtagtcaacaagagaaataaaaaagcccagcaggtacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 447202 - DNA, 6155 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 447203 - DNA, 2340 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtgagtgagccccgggagggcgggcgaggggctgcagggcgcggcgggccgggggcgcccgtggagccggacggacttgggcgtagcaggcggggacccggacccgctggccgccggggcaccgggcacggcgcagggtctcccgcctctgcagggtccgcgaaggtcttcccgacccggtccctgctatccgaagagcgggtcgcggggtctgggtggctccgcgcgccccgggccgtgaccccggcacccatggaccccgcggagcttcctccccggcggctgtgggctgcatcgccgcagggaggtcagtccgcgtccctcggctgtccagtcccttcggggctaggacctggccggtcccgggtggagccaggttctcgcgcggagcctccgcagggcaagagccggagctggatcgcagtctgcgcgcgggccccgggactcttgtggctgcgggagagtttcgccggcagcctcctgtatttgtgtgtggactccggatgtgtcttggcagtgatgctgctttccagttgggctcgtttcagagtccagagtccagagcgggaaacacagggctcccagtgatcccatttcctgtggccaggcattgtcaccacggaggccccaaacgaggagcgggaccagatgacctacagctccctggatcctccccgtgactggccgggcctggggtcgctgtcaacttgttgaagtcctttcgtgccgctgccttcctcggccgcccaccatgtggatttcatataaggcttgtgtgcattccagaagtgtggggggttggccgggggaagggggttggaactgcaaacgcagcggctgcagcctgtcctgcccgtgaaatggctgtgctcccggtctggcctgggaacactgcgccttagacaacactcacgtggaacttgtaggctttgcctaaaacgaatgagcccttcaagtctggatccacaaagagccctcccccatgttggttgactgccctggcccctttgcacactggtgaagcctgtggatcccttttcagtataacgcttttattttagtttttagagagacgaggtcttgctctgttgcccaggctgggtgcagcggtgcgatcttgggtcactgcagcctccaactccttggctcaagctgtcctctggcctcagcctcctgagtagctgggaccacaggcgagtgtcaccatgctgggcagtataaagttttaaatgcataaaataaaatccacaagatgaccaaggaaggcaattatgttgaaatacagatcaaaatattaaaaaaacacacatcttatgctcttatgtactatatatgcttatatgcttactttatttatttatttatttatttatttttttttttgagacagagtctctctctatcccccagcctggagtttagtggcacaatctcagctcactgcaacctccacctcctgggttcaaatgattctcctgcctcagcctcctgagtagctgggattacagatgactgccaccacacttggctaatttttgtattttaagtagagacatggtttcaccatgttggccaggctagtcttgaactcctgacctcagatgatctgcccacctcagcttcccaaagtgctgggattacaggcatgagccaccatgcctggcccaatatatgcttacttt

SEQ ID NO: 447204 - DNA, 459 bp, Homo sapiens
ccttgtgcaggatgacctgggcttgcccaatggactgaccttcgatgcgttctcatctcagctctgctgggtggatgcaggtgatggaaagctggacactgtccagggcgggtctcaatctcctaagtcaggggtgggcaaactagggccctggggtcaaatctaaccagccacctgtttttatataacccagaagctatgaatggtttttacggttttatctggtacattaaatatatactggtacaaaattgtatagatacctgcatactgtccttggttttgcctcctggcctgcaaaacctgaaataatttactatctggtgctttaagaaaaagttggccaccctcgtgttgtaagtggcactgcacagagcctggagtcaccctgataccgataagcaattcacaacttacattagtctgccctggctcgtgcctccccagcagaagcaacac

SEQ ID NO: 447205 - DNA, 389 bp, Homo sapiens
cagcgccgggtgctctttgagactgacctggtgaatcccagaggcattgtaacggattccgtgagagggtatctttgtgtaaatatgtgtgtgcatctctttgatttgcatctgcccttttagagattctcagatgtgaggctttaactccagcattggtctcctgaaattaatgagtacgggacgaaagagtctacagttttggtgacttgtagatatccacggtacaatgccagaacatgtattacagtgtggacttgataccatgtcccactttcaaatcttttgccaggagactttacaagttggcatgctcagaaattggatattttccatatggcttcaatgtggatcaacactcaggttatatcaactccagaagagtagca

SEQ ID NO: 447206 - DNA, 1979 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtgagtgagccccgggagggcgggcgaggggctgcagggcgcggcgggccgggggcgcccgtggagccggacggacttgggcgtagcaggcggggacccggacccgctggccgccggggcaccgggcacggcgcagggtctcccgcctctgcagggtccgcgaaggtcttcccgacccggtccctgctatccgaagagcgggtcgcggggtctgggtggctccgcgcgccccgggccgtgaccccggcacccatggaccccgcggagcttcctccccggcggctgtgggctgcatcgccgcagggaggtcagtccgcgtccctcggctgtccagtcccttcggggctaggacctggccggtcccgggtggagccaggttctcgcgcggagcctccgcagggcaagagccggagctggatcgcagtctgcgcgcgggccccgggactcttgtggctgcgggagagtttcgccggcagcctcctgtatttgtgtgtggactccggatgtgtcttggcagtgatgctgctttccagttgggctcgtttcagagtccagagtccagagcgggaaacacagggctcccagtgatcccatttcctgtggccaggcattgtcaccacggaggccccaaacgaggagcgggaccagatgacctacagctccctggatcctccccgtgactggccgggcctggggtcgctgtcaacttgttgaagtcctttcgtgccgctgccttcctcggccgcccaccatgtggatttcatataaggcttgtgtgcattccagaagtgtggggggttggccgggggaagggggttggaactgcaaacgcagcggctgcagcctgtcctgcccgtgaaatggctgtgctcccggtctggcctgggaacactgcgccttagacaacactcacgtggaacttgtaggctttgcctaaaacgaatgagcccttcaagtctggatccacaaagagccctcccccatgttggttgactgccctggcccctttgcacactggtgaagcctgtggatcccttttcagtataacgcttttattttagtttttagagagacgaggtcttgctctgttgcccaggctgggtgcagcggtgcgatcttgggtcactgcagcctccaactccttggctcaagctgtcctctggcctcagcctcctgagtagctgggaccacaggcgagtgtcaccatgctgggcagtataaagttttaaatgcataaaataaaatccacaagatgaccaaggaaggcaattatgttgaaatacagatcaaaatattaaaaaaacacacatcttatgctctt

SEQ ID NO: 447207 - DNA, 6008 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgtt

SEQ ID NO: 447208 - DNA, 5714 bp, Homo sapiens
  misc_feature (5663)..(5664): n is a, c, g, or t
  misc_feature (5668)..(5668): n is a, c, g, or t
  misc_feature (5683)..(5683): n is a, c, g, or t
  misc_feature (5691)..(5691): n is a, c, g, or t
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaaatgnncttngcaagacctttttgngactgggnaattgccgaaccttgggaaagac

SEQ ID NO: 447209 - DNA, 6140 bp, Homo sapiens
tggaccccggacgcggccgagcggcaatggggtgggcgccgttcctgaatccggagcgtttccacgtcgccggctctccacgacccaaccctaatcagaggaccacggtgcgggtcccgcgctctgctccccctcccggaggcgccgttcgctgggagtcgggctggtttcgagaatcgcaggcaccggcgcccaaggcgggaggttcggcttcgcccctcgccctccccctcgcggccattgggctgccccgcggcgcgcccgctggacggggcggggccctccgctctcccctccgctcccctcccctatttcccggggtgggaacgccgggaggcgggaggagagggggctgccaggggcgtccggttacatccccgccttcctctgtcctggccgcgggaccgggtttgcgggaccgcagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgagtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctacgctttcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgatattgatgaatgttcagaacaaccctcagtgtgtgggagccacacaatctgcaataatcacccaggaaccttccgctgcgagtgtgtggagggctaccagttttcagatgagggaacgtgtgtggctgtcgtggaccagcgccccatcaactactgtgaaactggccttcataactgcgacataccccagcgggcccagtgtatctacacaggaggctcctcctacacctgttcctgcttgccaggcttttctggggatggccaagcctgccaagatgtagatgaatgccagccaagccgatgtcaccctgacgccttctgctacaacactccaggctctttcacgtgccagtgcaaacctggttatcagggagacggcttccgttgcgtgcccggagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacctggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacggaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaa

SEQ ID NO: 447210 - DNA, 420 bp, Homo sapiens
ctcaccagttgtggttgactttctgtggaaggaggaaacctgcaagagctcctgaagactcacttggttccaatgtctctgtcttcacagaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatggtacagcctttgattctgacttgttggggctgggaaatcaggcgaggaggaggcatccacgttctgtaaaccagagaactgggtgcagcaaggaagcacggatgagataaatactggtggacatgccaggcctgaattatttatgcttcacattcactgttcccgtgggtaaactcgggagtactg

SEQ ID NO: 447211 - DNA, 2673 bp, Homo sapiens
gccacgctctgacctttgcctctcctctccctgcagatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447212 - DNA, 3445 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447213 - DNA, 3384 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447214 - DNA, 2420 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447215 - DNA, 426 bp, Homo sapiens
ctctcacccaccctctgagattgcagaagggagcttttgataaagcatcataaaatatcactgttgcaggctaatgagccccgctctgatggctgtgttgcagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacaggtgtgtgacatgccgccccccatcccctgtgggtgccaggggctctcaacctcaatgcttcatgccctgagctgcagctttcagaaaggcctcttgctgccagtcagaaatggggctcgggccaggcgcggtgactcacgcctgtaatcccagcactgcgggaggccgaggcag

SEQ ID NO: 447216 - DNA, 3897 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447217 - DNA, 569 bp, Homo sapiens
  misc_feature (219)..(220): n is a, c, g, or t
tcgtggaagagagataaacgacgagcatcccctgcatgactgggcctgcctgccgtgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagnntcgccagcctgcagaccagctcaaattcacatgcattaccgacactccggaaattgtccatgtagggcccctgggcttgcctggtgagctcaggctgggccgaggcgtgtgagaaatcccccagctcgtgggggccctgcgtttatatggaacgcgtgtgtacgcagaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtaacgagtccttcccacaggggtcttttgtctcct

SEQ ID NO: 447218 - DNA, 2977 bp, Homo sapiens
  misc_feature (219)..(220): n is a, c, g, or t
tcgtggaagagagataaacgacgagcatcccctgcatgactgggcctgcctgccgtgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagnntcgccagcctgcagaccagctcaaattcacatgcattaccgacactccggaaattgtccatgtagggcccctgggcttgcctggtgagctcaggctgggccgaggcgtgtgagaaatcccccagctcgtgggggccctgcgtttatatggaacgcgtgtgtacgcagaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctaaaaaaa

SEQ ID NO: 447219 - DNA, 682 bp, Homo sapiens
caggcgccacatgctgggtcagtccccagcctcctgtccacagatccttctctgttctacctcctgggctgtgtccttccacaccctcagctcggtgctcaggcgtgggcagaactggctgggaaggggtggtccttagaggtgggctgtggagaaatgaagatcgagctctggctgccgccatggccttcccatgcaaaaagtattttgtcatccaaaatcaatattttggtcaggcacagtggctcatgcctgtaatcccagcactttgggtggccgaggtgggtggatcatttgaggtcaggagtttgagaccagcctgaccaacatggtgaaattccatctctaccaaaaatacaaaaaaattagctgggcatggtggtggacgcctgtgatcccagctactctcaggaggctgaagcaggagaatcgtttgaacccgggaagctgagattgcagtgagccgagatctcgccactgcactccagcctgggcaacaaagcaagactctttctcaaaaaaaaataaaaataaaaaaatacaggccggacgcagtggctcacgcctgtaattccagtactttgggaggccgaggcaggtggatcacgaggttaggagatcaagaccatcctggctaacacggtgaaaccccgtctctactaaaaatacaaaaaaaaaaaaa

SEQ ID NO: 447220 - DNA, 200 bp, Homo sapiens
aaaaaaaaaaaggaaaaatagtaagaaaataatgtacagttggtactcagatgtggggcctaagctatgaatgggactagagcattgctacaggttgggcattgctgggcactgtatgtaggtcgcctgaccctatctcccatgggagtgatgaccagtcccagaggcctgtgtgactctgaatcttccaacctcacagg

SEQ ID NO: 447221 - DNA, 3306 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447222 - DNA, 3361 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctggaaaaaaaaaaagggggggcctaaaatacccgagaggccaagtaactccatttttac

SEQ ID NO: 447223 - DNA, 2908 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447224 - DNA, 3127 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaaggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447225 - DNA, 3045 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttaggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447226 - DNA, 2879 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447227 - DNA, 2108 bp, Homo sapiens
tgcctgcggttagtgatctagaggatcccttcgggctccattcaggacgggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447228 - DNA, 2191 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcatcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447229 - DNA, 1513 bp, Homo sapiens
tgttggaattacaggggtgagctaccacgctggccaagaatcacttcttaatgcactgtcccccgattaagggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447230 - DNA, 1993 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtggtgagggcccaccatggctggcatggggtggggagcactccctgttcccacaaaccagcaacttctcctgggcttgtccaggcccagcagggagaggctcgttgctgtcttgttttgtaagcagcagat

SEQ ID NO: 447231 - DNA, 1650 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttaggtgagcccagggcaggtgctgaggtcaggtccccccctcttccttcacctcctgcccccacctcccccaggccctgctaagtatctgcagttggaaggagccaccaccagggggcccccttctccagcaccgaccttgggtttctcctctctgaggacacagagcaggggccggccccctgttgagaggccctgtgggccaacccccttaacaggcatcttatttactacccgcagctggacaggaggcagacccatccccttttcacaactggggcttgggggg

SEQ ID NO: 447232 - DNA, 1862 bp, Homo sapiens
  misc_feature (1542)..(1542): n is a, c, g, or t
  misc_feature (1861)..(1861): n is a, c, g, or t
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaagggaggccaagactgaggttcttggggtccataaggctcttcagagcccaagagagttgtgctaagatggcccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggctccacccagacctgccgaggccacactcctggagtatctgcatccagagatctgcacgtttgtaaagctaaggggtggtgcttgggctcaggcctgaggttttgcatctgttcaatagcagaggagagaggggtgtactgtctgtggcccccagcatgggccacataccaacccaccatggagcaaagctgattttaagtggtggtagagatacagtttctcttttaatacttacgtgtttagttgggtgcagtggcttatacctgtaatttcagcacttggggaggccaaggcaggaggcttgcttgaggcaaggagttcaaggctacagtgagctatgattgtgccactgtactccagactggacaacagagtgagaccccatctctaaataataatcattattgttacatatttgttttaacatttttttctcaagtataactagtcctatgatttcatagatgtagcttaggataaggccaaggtagntgttgcctatataaggtttttttaaaaaaggaaaaataggccgggctggtggctcacgcctgtaatcccagcactttggcaggctgaggcgggcagatcacctgagatcaggagttcaagatcagcctgaccaacatggagaagccccatgtctactaaaaataaaaaattagcgaggcgtggtgggcgggcgcctgtaatcccagctacttgggaggctgaggcagaagaatcatttgaacccaggaggcagaggttacagtgagccgagatcgtgctactgcattccaacctgggcaacaagagtgaaactctgtcnc

SEQ ID NO: 447233 - DNA, 272 bp, Homo sapiens
ctagagcattgctacaggttgggcattgctgggcactgtatgtaggtcgcctgaccctatctcccatgggagtgatgaccagtcccagaggcctgtgtgactctgaatcttccaacctcacaggccattccctcccttctgaaagcccacccatgggcttctggcccctgtccaaggcgtgggagggaggccacggcctctgatgcacctgggcgtcccctcccatcccccctccctgcacaggtgctggaaacatgcatgaagagctgcgg

SEQ ID NO: 447234 - DNA, 578 bp, Homo sapiens
acagagctttggagtggcctggccaggaagaggggaagcgtgtgtggggtcagcacaaggggttgccgggatcttggttactggttctgctctgctgctggttccctctgaaaatgtgggtttctcccctccgtgctgagcctcagaaaggggtagggagccccatgccagcacacatggcccctcggctctctggcctctgcagggtcagcccagctccttcacctctctcctgctttcccctcaggcctcagtgaccccacacccccttcaggcccaagcctggatggtaccggatggaacagcttccaggtaggaggggaccacaaactagtctggcctgtcccagtcccagggtcagggcagctgggacaagtggcctggagaaactaaaaggatggatgggctctactcaagagcccagggccagggggtggcccaggggcctggagacacccacccagggtacagggcctccccttacctccagctgtatcttccccaagtctcagccttggggctgcagcccagcctttgggattgggattgagatgggcaatccctcttcctttcccttg

SEQ ID NO: 447235 - DNA, 210 bp, Homo sapiens
cccacagtccttcagcctggcctctcccctcctgcctgttccagcggagatcctgcaggccaatgacaacctcacccaggtgatcaacctgtataagcagctggtgcggggtgaggaggtcaacggtgatgccacagccggctccatccctggtgaggaggtggcaggagagctgggagggcacccatcaggctggaggggcacagagag

SEQ ID NO: 447236 - DNA, 1206 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgcaagtagtcacatttgctcattaccccgtcctggaagggaggacccactgccccatttgattcctcccgccgctcctagtctctagccacatagtgagaaacccccgcaccctacaggcttgggagagtcttagactccagaagtattaataattccaagctccctgtcactcccttcagcctaacccctcagtctccaagatgcctttcccagctcttgctgaacttccttcaaaggcttctacacccctttttttcttgtttctcctcagacgtagcttcctattgcttaggcttcctagcccgcaaaccctccacctgagctccttaacccacagccctgatgatcccctgctctcacagccccgctcctggactctgcctctgaaagccgtggctggcttctccctggtctagtgagggttctctcccaaggctttaactgctgttgggaccccgtcgttgccagggcctcagggaaccctcttggacccgggcacaccggcaactgtctagcgtggtttggggtcatggccggccccttttaagccaggcttgagcagagttgaaccatgaggttggccccagaaccaaacctctagggatgtttcagagtcatcctagccaccagaggggcagggggtggaaaaggggcactcagcagcccttgaccgttgtgaacgccggaagtgtccgcctgggtctcagcagcaactgggctggggggatgggtgggcccctggctaactgatctcagacacaggtcttgagctgtgggtcatacaaaacattctcaggtttagaaacagtgggggttttctgaga

SEQ ID NO: 447237 - DNA, 892 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgcaagtagtcacatttgctcattaccccgtcctggaagggaggacccactgccccatttgattcctcccgccgctcctagtctctagccacatagtgagaaacccccgcaccctacaggcttgggagagtcttagactccagaagtattaataattccaagctccctgtcactcccttcagcctaacccctcagtctccaagatgcctttcccagctcttgctgaacttccttcaaaggcttctacacccctttttttcttgtttctcctcagacgtagcttcctattgcttaggcttcctagcccgcaaacctccagcctgggcaacaaagcaagactctttctcaaaaaaaaataaaaataaaaaaatacaggccggacgcagtggctcacgcctgtaattccagtactttgggaggccgaggcaggtggatcacgaggttaggagatcaagaccatcctggctaacacggtgaaaccccgtctctactaaaaatacaaaaaaaaaaaaa

SEQ ID NO: 447238 - DNA, 3522 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcagcagcgaggacctcatgaaggaactgtaccagcgctgtgagcggatgcgtcccacgctcttccgactggcgagtgacacagaggacaatgatgaggccttagcggagatccttgcaggccaatgacaagctcacccaggtgatcaacctgtataagcagctggtgcggggttgaggaggtcaaccgggtgatgccacagccggtctccatcccttgggagcacctcgtgcctgctgtatctcttcagtgccttggatctcccgcctgctgggcacacctacccagctatgcccaacctgcctggcgagcaggccagccctgagcagcccagtgcctcagtttccctggcttgacgacgagctcatgtctctgggcctcagtgaccccaaagccccttcaggcccaagcctggattgtaccggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447239 - DNA, 2793 bp, Homo sapiens
  misc_feature (59)..(59): n is a, c, g, or t
gaaattaatggctaggtacgaggctgggtttaaattcggccgaggctctggaggcgcgnatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447240 - DNA, 3032 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaaggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447241 - DNA, 3150 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctactcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447242 - DNA, 2170 bp, Homo sapiens
tcgcctccagtccagccctgtcctcgtattcttggggacactgtggctcagccagcacagtgcctagcccacagtcacccagcaggcgtccctcgagtgggccagtggcaggcacagagctgctctccccttgcctggatgcgtgaggaaaggaacctcttctccctgcagcccagccctgcaggctctctgctgccagatgacgagtgaagatgaaagtcctgatgtctattgtctgtgtgcacagagctttggagtggcctggccaggaagaggggaagcgtgtgtggggtcagcacaaggggttgccgggatcttggttactggttctgctctgctgctggttccctctgaaaatgtgggtttctcccctccgtgctgagcctcagaaaggggtagggagccccatgccagcacacatggcccctcggctctctggcctctgcagggtcagcccagctccttcacctctctcctgctttcccctcaggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447243 - DNA, 1670 bp, Homo sapiens
tatatgagctcggtaccggggttcagagactggatggtaccggatggaacagctctcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 447244 - DNA, 1924 bp, Homo sapiens
aatgcccagaatactgtaagcactcaagaaactgatttattttcgtcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcaagcaaaacacacacaacaggcatcacatctccgggagcaagcagcacc

SEQ ID NO: 447245 - DNA, 662 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgcaagtagtcacatttgctcattaccccgtcctggaagggaggacccactgccccatttgattcctcccgccgctcctagtcttccagcctgggcaacaaagcaagactctttctcaaaaaaaaataaaaataaaaaaatacaggccggacgcagtggctcacgcctgtaattccagtactttgggaggccgaggcaggtggatcacgaggttaggagatcaagaccatcctggctaacacggtgaaaccccgtctctactaaaaatacaaaaaaaaaaaaa

SEQ ID NO: 447246 - DNA, 3608 bp, Homo sapiens
ctcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447247 - DNA, 3452 bp, Homo sapiens
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447248 - DNA, 3053 bp, Homo sapiens
gcattggggcgcgcacagatgggttgaatctaatccaacagtgggcttggcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447249 - DNA, 3013 bp, Homo sapiens
ctcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccgcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447250 - DNA, 1375 bp, Homo sapiens
gagtgatgtaggaggccaggcaccggttgttaattgtcagtgacgcgggcgggcgcttggctgcgatcagtgactggggcgtcggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447251 - DNA, 3891 bp, Homo sapiens
ctcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447252 - DNA, 3164 bp, Homo sapiens
taattcaagtacgatggcgtggcttcattgctgatgttgtgtgagcgtggccgctgctgtacactggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtg

SEQ ID NO: 447253 - DNA, 1482 bp, Homo sapiens
ctcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcaggactcattgcagagttctggcacctgggggcctgttccatcgtggggtcggaacgcgcgcttcacggggcgggacatcggggccagggg

SEQ ID NO: 447254 - DNA, 752 bp, Homo sapiens
accggttccacttcttcaggctcaggattttcactcttctcgaatgggggtggccctcccccaatcttctgagtcgcaacagcatctccctccctccaggacctcagagccagagctgggcgagaggccctgacctccggggtagggtggaagcgtccctgtgaaggtgcagtcctgcctcccatccccaggcgccgggcctctcccaccctcagcgccctgctcacctccagctgaagatgccagggcacctctgcttcctccctgccctctctgcagtaccgccgagtgtgcataaaagggtttaatataggctttgccgggcgcggggactcccacctgtaatcccagtacgttgagagaccaaggcgggaggatcacttgaggccaggagttcaaaaccagcctgggcaacaaagtgaggcccgtctctgaaaaaaaaaaaaaaaaaaaaaaaagaataaaagaggtccctttttctgggagattgatataggggagtgtgagttagaagggaggcatcgaggatcagtcatttaaagcagcatccaagggtgttcaaggctagagatccacaggtgtattttcagaaactgaatttcctggcggggcacagtgactcatgcctgtaatcccagcactttgggaggccaaggtgagcggatcacttgaggtcaggagttcaagactagcctggccaacatggtgaaactgtttttagaaaaaaaaaaaaaaaaaaaattggccgggca

SEQ ID NO: 447255 - DNA, 865 bp, Homo sapiens
tgagactctatctcaaaatataataaaataaaaataaaatacactctgatgatggctgcttcccccaagggtgcctcaagctctctccttttctttcagtgccatctgccattatcgtgccctcgttctcttccagtgctctggcggagcaggtggcgcccaggcccacagtgccctctccaagttctgtcctccatgtgctcaagttatcccctaaacttgtcacatgggtcatcctggaactttgcttaactgcttcctgggttggggcctttatttcctggctcccttctcttcttgcttaatttcccctccctttgctgcagcacatacccagttaatccctttctaacattaaaaaaagaaaaagagaatagttcttggacctcctcatgatagaaattatatctttaggccgggtgtggtggctcacttgtgtaatcccagcagtttgggaggccgaggcaggtggatcacttgagctcaggagttcaaaaccagcctgagcaacatggtaaaaccctatctctacaaaaaaaaaaaacaacaacaaacaaaaaaaaattgtgtgtggggcgcgcgcttgggccctggaaaaggcttttttagaaacccttgcgcgtgggggcgcgcgcggggccccatgggtagggtgggcacccgtgggtccaaaaagcgcggttcccaaaggagaaccggggccatggacaaagcggtggggatttccttcccaataaaaaaaagcgcccgggggaagcacggacggcgttccggaaccaatcccagaagggagtccgaaggccctagcggggcgtctatacccgggagctccaggaagccgatataaattgcgcgcctgggaggc

SEQ ID NO: 447256 - DNA, 699 bp, Homo sapiens
tgagactctatctcaaaatataataaaataaaaataaaatacactctgatgatggctgcttcccccaagggtgcctcaagctctctccttttctttcagtgccatctgccattatcgtgccctcgttctcttccagtgctctggcggagcaggtggcgcccaggcccacagtgccctctccaagttctgtcctccatgtgctcaagttatcccctaaacttgtcacatgggtcatcctggaactttgcttaactgcttcctgggttggggcctttatttcctggctcccttctcttcttgcttaatttcccctccctttgctgcagcacatacccagttaatccctttctaacattaaaaaaagaaaaagagaatagttcttggacctcctcatgatagaaattatatctttaggccgggtgtggtggctcacttgtgtaatcccagcagtttgggaggccgaggatcagtcatttaaagcagcatccaagggtgttcaaggctagagatccacaggtgtattttcagaaactgaatttcctggcggggcacagtgactcatgcctgtaatcccagcactttgggaggccaaggtgagcggatcacttgagcccggaaggcggtaactcaaccccagcagaatcccagggagcgaaggtggctcatcccaaaagaaaacaagaagaattctataccgga

SEQ ID NO: 447257 - DNA, 393 bp, Homo sapiens
tcttcccatgccctcctctcctaccctcccctacctcccgtttaattgtcatgccatttccaggtcctcctgaggctttgttggaaaatcgtgttgaaattgtaactaggccagacatggtggctcacacctataattccagcactttaggaggctgaggcggacagatcacttgaggccaggcattcaagaccagcctggccaacatggtgaaaccctatctctactaaaaataaaaaaaaattagccaggcgtggtggtgcgtgcctgtaatcccagctactcaggaggctgaggcacgagaatcgcttgaacctgggaggcagaggttgcagtgagctgagatagtgccactgcactacagtgtgggcaatagagtgagactgtctcaca

SEQ ID NO: 447258 - DNA, 291 bp, Homo sapiens
accaaaagccagttttcaaagcccttctgagttttccctctatttattaatctctttaagctgataacacaaagaaaacatgtcaacgagtactaccaagagaagaagacaagaggtcaacacagactcattttctactccgtgtgaatgatagctacagcaggggaaagtttcatagtctatcagtgggtcagaaaatggaggtaatcagcagtgtggcgggagggttcttctttccctcctagggtacgttacctgctttatacatattttttaagaaacaggctttga

SEQ ID NO: 447259 - DNA, 8514 bp, Homo sapiens
  misc_feature (908)..(908): n is a, c, g, or t
  misc_feature (931)..(932): n is a, c, g, or t
  misc_feature (934)..(937): n is a, c, g, or t
  misc_feature (940)..(940): n is a, c, g, or t
  misc_feature (944)..(944): n is a, c, g, or t
  misc_feature (946)..(947): n is a, c, g, or t
  misc_feature (950)..(950): n is a, c, g, or t
  misc_feature (952)..(952): n is a, c, g, or t
  misc_feature (3891)..(3891): n is a, c, g, or t
  misc_feature (3893)..(3893): n is a, c, g, or t
cgggatggcaactgcggtcaccctgctaaagtcggggcggggcggcggtcctccccctcaccccccccagtccgagcgccgccgccgccgccgccgccgccgccggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447260 - DNA, 8480 bp, Homo sapiens
  misc_feature (908)..(908): n is a, c, g, or t
  misc_feature (931)..(932): n is a, c, g, or t
  misc_feature (934)..(937): n is a, c, g, or t
  misc_feature (940)..(940): n is a, c, g, or t
  misc_feature (944)..(944): n is a, c, g, or t
  misc_feature (946)..(947): n is a, c, g, or t
  misc_feature (950)..(950): n is a, c, g, or t
  misc_feature (952)..(952): n is a, c, g, or t
  misc_feature (3891)..(3891): n is a, c, g, or t
  misc_feature (3893)..(3893): n is a, c, g, or t
cgggatggcaactgcggtcaccctgctaaagtcggggcggggcggcggtcctccccctcaccccccccagtccgagcgccgccgccgccgccgccgccgccgccggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447261 - DNA, 8460 bp, Homo sapiens
  misc_feature (908)..(908): n is a, c, g, or t
  misc_feature (931)..(932): n is a, c, g, or t
  misc_feature (934)..(937): n is a, c, g, or t
  misc_feature (940)..(940): n is a, c, g, or t
  misc_feature (944)..(944): n is a, c, g, or t
  misc_feature (946)..(947): n is a, c, g, or t
  misc_feature (950)..(950): n is a, c, g, or t
  misc_feature (952)..(952): n is a, c, g, or t
  misc_feature (3891)..(3891): n is a, c, g, or t
  misc_feature (3893)..(3893): n is a, c, g, or t
cgggatggcaactgcggtcaccctgctaaagtcggggcggggcggcggtcctccccctcaccccccccagtccgagcgccgccgccgccgccgccgccgccgccggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447262 - DNA, 8559 bp, Homo sapiens
  misc_feature (953)..(953): n is a, c, g, or t
  misc_feature (976)..(977): n is a, c, g, or t
  misc_feature (979)..(982): n is a, c, g, or t
  misc_feature (985)..(985): n is a, c, g, or t
  misc_feature (989)..(989): n is a, c, g, or t
  misc_feature (991)..(992): n is a, c, g, or t
  misc_feature (995)..(995): n is a, c, g, or t
  misc_feature (997)..(997): n is a, c, g, or t
  misc_feature (3936)..(3936): n is a, c, g, or t
  misc_feature (3938)..(3938): n is a, c, g, or t
ttcagacacctgagagcatcctgttctgggtacagtgtgtgtatgtatatgttgtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447263 - DNA, 9474 bp, Homo sapiens
  misc_feature (1703)..(1703): n is a, c, g, or t
  misc_feature (1726)..(1727): n is a, c, g, or t
  misc_feature (1729)..(1732): n is a, c, g, or t
  misc_feature (1735)..(1735): n is a, c, g, or t
  misc_feature (1739)..(1739): n is a, c, g, or t
  misc_feature (1741)..(1742): n is a, c, g, or t
  misc_feature (1745)..(1745): n is a, c, g, or t
  misc_feature (1747)..(1747): n is a, c, g, or t
  misc_feature (4686)..(4686): n is a, c, g, or t
  misc_feature (4688)..(4688): n is a, c, g, or t
tgggccgctctagagtatcccctcgtcttttgataggattgtacatagatgctgttaacagaactttgcctttttcattcctatcaggtttagtacagttcatgcgcaggtttcagtaaacattaactacttttatcagagcttgcagtgtgctgaatggttagcaaagagagtgtactgcaagagacagatgaaaatgagagagtccaaggtcacatggattttgaattttttttaattattgagaatttaggggaaagaccatcaggcttcacactttaaatctctttatgtgggcctgccacacagcgtctttgccagcttttgtatgtactgaagctaaaacatttgttcagatgctgattggcaaggcaagtgactttaaaacatggtttttttttctttcaattaaaaaaagttttattcagggctgccttctaggatgaaagattctcaaggccctatcaaaagacgtaatgcaacacttatcgtggtgattcttaagactcctttgaattttatagggatatcctttttctcaaagatttttcaggattgccttctgataatctatttcgtttctggagttagcacagtaactcgtaaaccaagtgctaaaagatgaaatctgaaacacagatatagaataaacgtgttttggatatcatgtaatgttccccaacttttgcctatcattttcgaaaacaggaatgtgatctgtacttatttttagagaaaaggacacgaacatttgagaaattactgacaaaaattattctcctcctgcccctccgatccaataggtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447264 - DNA, 4596 bp, Homo sapiens
agttcgacggagactctcctcagagccatgagccggaggaggagcatggcactgaggagagcactggggacgccgacggcgcggaagaggacgcgtcgagcaaccagagcctggacctgaggtgatgtggaggctgcttttgcctttcttcacgtccccagggtcatcttggtcctcctgggggatgtaacaggtggtgaggatttgggccgaaagaagtcctcactggtttggggttcaggctgctggcgtgggtctagcccattcccggcgacatccctggcatgggcgtacctggtggtgcccctctgagccctccccgctgtgcttgccccacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447265 - DNA, 2718 bp, Homo sapiens
ggctatcacattatcttgtttacagatgaagaaaagccaaagagaagttatataactggcaagtttctctggctccccgcctgcaccactgctcaccagattgcatgaagagggaggcagctgtaacacctcataccgttgatctccagtgaactcagatacttgtttccacgtccaggaaaccacaaactaagctctttgaagcatcagcaaaccttgctaagtgacacgtgaatgataatgtgatagccggctatcacatttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447266 - DNA, 970 bp, Homo sapiens
ggcactttctagttgccaagcatgactcagccatggagaagacagaggtttacagtggaaaacaatgaccatgacattcagagaaaagtatagagggtagggcgagcccagctggcatgccagtccacctgtccaaatccttcacacatttcctattaggcttcttgtagattatcaagattccttgtgcattctgtatattcgtccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447267 - DNA, 5458 bp, Homo sapiens
  misc_feature (1703)..(1703): n is a, c, g, or t
  misc_feature (1726)..(1727): n is a, c, g, or t
  misc_feature (1729)..(1732): n is a, c, g, or t
  misc_feature (1735)..(1735): n is a, c, g, or t
  misc_feature (1739)..(1739): n is a, c, g, or t
  misc_feature (1741)..(1742): n is a, c, g, or t
  misc_feature (1745)..(1745): n is a, c, g, or t
  misc_feature (1747)..(1747): n is a, c, g, or t
  misc_feature (4686)..(4686): n is a, c, g, or t
  misc_feature (4688)..(4688): n is a, c, g, or t
tgggccgctctagagtatcccctcgtcttttgataggattgtacatagatgctgttaacagaactttgcctttttcattcctatcaggtttagtacagttcatgcgcaggtttcagtaaacattaactacttttatcagagcttgcagtgtgctgaatggttagcaaagagagtgtactgcaagagacagatgaaaatgagagagtccaaggtcacatggattttgaattttttttaattattgagaatttaggggaaagaccatcaggcttcacactttaaatctctttatgtgggcctgccacacagcgtctttgccagcttttgtatgtactgaagctaaaacatttgttcagatgctgattggcaaggcaagtgactttaaaacatggtttttttttctttcaattaaaaaaagttttattcagggctgccttctaggatgaaagattctcaaggccctatcaaaagacgtaatgcaacacttatcgtggtgattcttaagactcctttgaattttatagggatatcctttttctcaaagatttttcaggattgccttctgataatctatttcgtttctggagttagcacagtaactcgtaaaccaagtgctaaaagatgaaatctgaaacacagatatagaataaacgtgttttggatatcatgtaatgttccccaacttttgcctatcattttcgaaaacaggaatgtgatctgtacttatttttagagaaaaggacacgaacatttgagaaattactgacaaaaattattctcctcctgcccctccgatccaataggtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtaagagggccaccgggctcccaggcagtgagtcctacttcctggtagggggagccacgagtgggggtcaaaagcgagacccatctcccacagttccagttattcctagcttggcttcttccccggtctccgaagccccgagcttgtctggtggtgctgtatttcctatgtgctctcagtacccacatggcctttgtgcaggggccgagccctccaagggcagcattctactaagtgttcatccggggcgttttgaggtgaaagtggtcacaggccctcagatcactcatggcgtcgcctcatcccttccggaggtggtagccagattatctgctgggttaaacagggaggcggctccacagacgtgagactttgtattaaggtattggggcataatgagctcggt

SEQ ID NO: 447268 - DNA, 1695 bp, Homo sapiens
tgggccgctctagagtatcccctcgtcttttgataggattgtacatagatgctgttaacagaactttgcctttttcattcctatcaggtttagtacagttcatgcgcaggtttcagtaaacattaactacttttatcagagcttgcagtgtgctgaatggttagcaaagagagtgtactgcaagagacagatgaaaatgagagagtccaaggtcacatggattttgaattttttttaattattgagaatttaggggaaagaccatcaggcttcacactttaaatctctttatgtgggcctgccacacagcgtctttgccagcttttgtatgtactgaagctaaaacatttgttcagatgctgattggcaaggcaagtgactttaaaacatggtttttttttctttcaattaaaaaaagttttattcagggctgccttctaggatgaaagattctcaaggccctatcaaaagacgtaatgcaacacttatcgtggtgattcttaagactcctttgaattttatagggatatcctttttctcaaagatttttcaggattgccttctgataatctatttcgtttctggagttagcacagtaactcgtaaaccaagtgctaaaagatgaaatctgaaacacagatatagaataaacgtgttttggatatcatgtaatgttccccaacttttgcctatcattttcgaaaacaggaatgtgatctgtacttatttttagagaaaaggacacgaacatttgagaaattactgacaaaaattattctcctcctgcccctccgatccaataggtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggtaagtgttcacacctagtggtgacctctggtgggttcaatccatgagaacattgggagatgtttccgagtttcctatgataaaaccttggaagaattgggaataaaacggacatacccagaggccttgatcatttttcaagggcaaaatttttatggcttatgttagtttcctttcatggagaaggttttctttgctgtggtgtcgatgttggtggaagtgcccttatttttggccccaccattggattttaactcaagctttcttcacttgatg

SEQ ID NO: 447269 - DNA, 683 bp, Homo sapiens
gttctgggtacagtgtgtgtatgtatatgttgtaagttgaaattttattttaactgaggtaattggagaaaaagggatagtgtagaaatgggaggaaaagacagtatcagtaagttaaaaatatcagtaggttctgatgtttaactcaatatactttgagtgaatgtaatggtaaatgttaaaattaaagatctggtttgactgaagttaactttacatttggagttaaggggagaaaaatagataactgttgaaatgttaaatttatttttgcataaaatagttctgctataacctatgtgtagctattcaaacaaataaatattcgacaatataactgaattggttattgatcaggtagttgggccttcaaaaaaaagtatgagaatatgaaatataaacagatttaagttctgtaaaaacaaaatctgtaaaatcattcaggtatatttgtgttcaaaattttccaaaaagattagattaaaagtatcttttaattggtgatatatattgactccattagactttggaaatttatattttatcagtcagaacttttagattcagactagaaaaaaaattccttcttggtcctttcccccacccaccctttttattgtacatagatgctgttaacagaactttgcctttttcattcctatcaggtttagtacagttcatgc

SEQ ID NO: 447270 - DNA, 644 bp, Homo sapiens
gtgtctgctgtgaacatgccattaggatgcacgaagctcccccccggagccagtggtccgagccattctcacatggtgctgcccttgacgttattggaatgtgcctgggggataggggtgttcctgtctgttcaaggcacactcagttccaagctcttacttggatgttaatgggacaactctggatggaatcagcctggctcctggcagcttgcttgtaattgcaggcaagggatgggaaatgttttctagtcctaattggtgactcccggtgatgttgagcagaggaccatttctggtcttaatcctcttttaacatcaccttttcttatttttgtaggttgctccgactgtgtgttccaggagtggtggctctgaggtgtgaccctgcccacgtttgggcccagccaggttcagccccccaataaggagggcagcttgataacacaaagaaaacaggttagtgaaacagttttcactcgcagtgagtcacaataatgttgaacgtcgagtcttcccatgccctcctctcctaccctcccctacctcccgtttaattgtcatgccatttccaggtcctcctgaggctttgttggaaaatcgtgttgaaattgtaactaggccagacatggtggctcacacct

SEQ ID NO: 447271 - DNA, 984 bp, Homo sapiens
gaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggtaagtgttcacacctagtggtgacctctggtgggttcaatccatgagaacattgggagatgtttccgagtttcctatgataaaaccttggaagaattgggaataaaacggacatacccagaggccttgatcatttttcaagggcaaaatttttatggcttatgttagtttcctttcatggagaaggttttctttgctgtggtgtcgatgttggtggaagtgcccttatttttggccccaccattggattttaactcaagctttcttcacttgatg

SEQ ID NO: 447272 - DNA, 8443 bp, Homo sapiens
  misc_feature (908)..(908): n is a, c, g, or t
  misc_feature (931)..(932): n is a, c, g, or t
  misc_feature (934)..(937): n is a, c, g, or t
  misc_feature (940)..(940): n is a, c, g, or t
  misc_feature (944)..(944): n is a, c, g, or t
  misc_feature (946)..(947): n is a, c, g, or t
  misc_feature (950)..(950): n is a, c, g, or t
  misc_feature (952)..(952): n is a, c, g, or t
  misc_feature (3891)..(3891): n is a, c, g, or t
  misc_feature (3893)..(3893): n is a, c, g, or t
cgggatggcaactgcggtcaccctgctaaagtcggggcggggcggcggtcctccccctcaccccccccagtccgagcgccgccgccgccgccgccgccgccgccggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447273 - DNA, 9309 bp, Homo sapiens
  misc_feature (1703)..(1703): n is a, c, g, or t
  misc_feature (1726)..(1727): n is a, c, g, or t
  misc_feature (1729)..(1732): n is a, c, g, or t
  misc_feature (1735)..(1735): n is a, c, g, or t
  misc_feature (1739)..(1739): n is a, c, g, or t
  misc_feature (1741)..(1742): n is a, c, g, or t
  misc_feature (1745)..(1745): n is a, c, g, or t
  misc_feature (1747)..(1747): n is a, c, g, or t
  misc_feature (4686)..(4686): n is a, c, g, or t
  misc_feature (4688)..(4688): n is a, c, g, or t
tgggccgctctagagtatcccctcgtcttttgataggattgtacatagatgctgttaacagaactttgcctttttcattcctatcaggtttagtacagttcatgcgcaggtttcagtaaacattaactacttttatcagagcttgcagtgtgctgaatggttagcaaagagagtgtactgcaagagacagatgaaaatgagagagtccaaggtcacatggattttgaattttttttaattattgagaatttaggggaaagaccatcaggcttcacactttaaatctctttatgtgggcctgccacacagcgtctttgccagcttttgtatgtactgaagctaaaacatttgttcagatgctgattggcaaggcaagtgactttaaaacatggtttttttttctttcaattaaaaaaagttttattcagggctgccttctaggatgaaagattctcaaggccctatcaaaagacgtaatgcaacacttatcgtggtgattcttaagactcctttgaattttatagggatatcctttttctcaaagatttttcaggattgccttctgataatctatttcgtttctggagttagcacagtaactcgtaaaccaagtgctaaaagatgaaatctgaaacacagatatagaataaacgtgttttggatatcatgtaatgttccccaacttttgcctatcattttcgaaaacaggaatgtgatctgtacttatttttagagaaaaggacacgaacatttgagaaattactgacaaaaattattctcctcctgcccctccgatccaataggtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447274 - DNA, 8560 bp, Homo sapiens
  misc_feature (954)..(954): n is a, c, g, or t
  misc_feature (977)..(978): n is a, c, g, or t
  misc_feature (980)..(983): n is a, c, g, or t
  misc_feature (986)..(986): n is a, c, g, or t
  misc_feature (990)..(990): n is a, c, g, or t
  misc_feature (992)..(993): n is a, c, g, or t
  misc_feature (996)..(996): n is a, c, g, or t
  misc_feature (998)..(998): n is a, c, g, or t
  misc_feature (3937)..(3937): n is a, c, g, or t
  misc_feature (3939)..(3939): n is a, c, g, or t
ggagcctgagcatccttgcaagggactgaggcacagtgtgaaagagaatttgatgcatgggtataaatatgagctttagaaagtaaaattttactgcagagtccttttggctgttgggagtgtgcgtaacaggcagtactgtaggggttaagataaggttgagaaacagctgtagaatgtggttttggaagaaagaaaggcagacattgcctctcatttgtgctccttgcattgttgtgaatatagtggtctaagattatagcccataaatgatttcagttttttcttcactaagtgaaaagatgttcactttgggcctttgcttcccttccagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttgtttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 447275 - DNA, 6150 bp, Homo sapiens
  misc_feature (908)..(908): n is a, c, g, or t
  misc_feature (931)..(932): n is a, c, g, or t
  misc_feature (934)..(937): n is a, c, g, or t
  misc_feature (940)..(940): n is a, c, g, or t
  misc_feature (944)..(944): n is a, c, g, or t
  misc_feature (946)..(947): n is a, c, g, or t
  misc_feature (950)..(950): n is a, c, g, or t
  misc_feature (952)..(952): n is a, c, g, or t
  misc_feature (3891)..(3891): n is a, c, g, or t
  misc_feature (3893)..(3893): n is a, c, g, or t
cgggatggcaactgcggtcaccctgctaaagtcggggcggggcggcggtcctccccctcaccccccccagtccgagcgccgccgccgccgccgccgccgccgccggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctancagtgccacagccacagccccanntnnnnganacgnanncgntngtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgngnacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagaaggtaagttcgggtcatgggtagagcagtatgaacaaagttcccaagattggagggatcggtaggaggctttatgggaaaggaatttgaaaagacaaagggacacaccgggtac

SEQ ID NO: 447276 - DNA, 475 bp, Homo sapiens
gctgggactagaggcatgagccaacacacctggctaatttttttttattttttgtagagatacgggatcttgctatattgcccaggctgggaactctttatgttatggggaaaggctgtgtactgggataaatgtacaacaaatactttgtgcatctccgtttagtgattattttttcaatcttcacatgtgttcccttgcttttaccggtgggttctatataggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcc

SEQ ID NO: 447277 - DNA, 1933 bp, Homo sapiens
ataaaaggaggtctgcacagcctctcttaaaacaacatgccacagttaaaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaatttaattattatttcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcaaagttatgagtctgtccctcaatgctccctgtcaactatcagtgggagtgtcagggaaaagataattggcaatagactttgaactgcaacattataaatgatgatgatgatgactgaggcaatgaaagcactgagcttttcctggagctgccagcacagtcttttagggcctctgcttagcaatatgaaaaagact

SEQ ID NO: 447278 - DNA, 1743 bp, Homo sapiens
ataaaaggaggtctgcacagcctctcttaaaacaacatgccacagttaaaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcactttcccatctccaactcggaagtaagcccaagagaacaacataaagcaaacaacataaagcacaataaaaatgcaaataaatatttcatttttatttgtaaacgaatacaccaaaaggaggcgctcttaataactcccaatgtaaaaagttttgttttaataaaaaatttaattattatttcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcaaagtta

SEQ ID NO: 447279 - DNA, 885 bp, Homo sapiens
ataaaaggaggtctgcacagcctctcttaaaacaacatgccacagttaaaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccaccgctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccacggcatcaccagtattagaggcaccgcctgcccagtgacacattttacgcccgtacccta

SEQ ID NO: 447280 - DNA, 749 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtga

SEQ ID NO: 447281 - DNA, 7353 bp, Homo sapiens
  misc_feature (2932)..(2932): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacatgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447282 - DNA, 8299 bp, Homo sapiens
  misc_feature (4)..(4): n is a, c, g, or t
  misc_feature (101)..(101): n is a, c, g, or t
  misc_feature (2015)..(2015): n is a, c, g, or t
  misc_feature (2172)..(2172): n is a, c, g, or t
  misc_feature (2180)..(2180): n is a, c, g, or t
  misc_feature (2218)..(2218): n is a, c, g, or t
  misc_feature (2270)..(2270): n is a, c, g, or t
  misc_feature (2272)..(2272): n is a, c, g, or t
  misc_feature (3878)..(3878): n is a, c, g, or t
tgtnagggaggtttcttcgtggccgcagttctcggggcggattccgaggaggcaggggcaatgggaccacccgtcgcaaccccacttcccacagggccggnactggcagggtgtgagggtgcagccaaaggctcctactgaagtggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447283 - DNA, 8736 bp, Homo sapiens
  misc_feature (498)..(498): n is a, c, g, or t
  misc_feature (2452)..(2452): n is a, c, g, or t
  misc_feature (2609)..(2609): n is a, c, g, or t
  misc_feature (2617)..(2617): n is a, c, g, or t
  misc_feature (2655)..(2655): n is a, c, g, or t
  misc_feature (2707)..(2707): n is a, c, g, or t
  misc_feature (2709)..(2709): n is a, c, g, or t
  misc_feature (4315)..(4315): n is a, c, g, or t
tatttttttttccctccaaacagatttattgaatacagcgaaattctatatacaaagtgacctggacctgctgcttcaaaacatgatcctttcttactaatatcttgatagtcggcccatagagcattagaaagcaatttgactcttaaattaaacagaaaagtgcctaattgcacatttacaattgacatggccataactacgtggaacctttagttagtctctatacagcgtaacttaaccatacgttaggactccagttccctagtgaccaggctgcttgaaggaacacgttattgagcatcaagaaggcccatttgtgtgcacttgccaccgttgaatgccactcggtgttctcgtggatcataagtgtccccatttatctgaattctagaacacacccacaggcaatactcaggtggggctcaagaggcttacgctatagctgcttgctgggcttagaacgagatatcacctccagacatgcctcatcttgancagggctccgcgcggcaaacccagaattaagctcctgtgtgaactctgtgcacagcgactccaacaagtggagggatctctctcatgtgtgtctctccaagttgctgctccaaggctcgcctccatcccacccaccgaccactccggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447284 - DNA, 8074 bp, Homo sapiens
  misc_feature (1790)..(1790): n is a, c, g, or t
  misc_feature (1947)..(1947): n is a, c, g, or t
  misc_feature (1955)..(1955): n is a, c, g, or t
  misc_feature (1993)..(1993): n is a, c, g, or t
  misc_feature (2045)..(2045): n is a, c, g, or t
  misc_feature (2047)..(2047): n is a, c, g, or t
  misc_feature (3653)..(3653): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccacattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447285 - DNA, 8187 bp, Homo sapiens
  misc_feature (1903)..(1903): n is a, c, g, or t
  misc_feature (2060)..(2060): n is a, c, g, or t
  misc_feature (2068)..(2068): n is a, c, g, or t
  misc_feature (2106)..(2106): n is a, c, g, or t
  misc_feature (2158)..(2158): n is a, c, g, or t
  misc_feature (2160)..(2160): n is a, c, g, or t
  misc_feature (3766)..(3766): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447286 - DNA, 3080 bp, Homo sapiens
  misc_feature (1981)..(1981): n is a, c, g, or t
  misc_feature (2138)..(2138): n is a, c, g, or t
  misc_feature (2146)..(2146): n is a, c, g, or t
  misc_feature (2184)..(2184): n is a, c, g, or t
  misc_feature (2236)..(2236): n is a, c, g, or t
  misc_feature (2238)..(2238): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagaggg

SEQ ID NO: 447287 - DNA, 3993 bp, Homo sapiens
  misc_feature (1981)..(1981): n is a, c, g, or t
  misc_feature (2138)..(2138): n is a, c, g, or t
  misc_feature (2146)..(2146): n is a, c, g, or t
  misc_feature (2184)..(2184): n is a, c, g, or t
  misc_feature (2236)..(2236): n is a, c, g, or t
  misc_feature (2238)..(2238): n is a, c, g, or t
  misc_feature (3844)..(3844): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtgagctgagatggcaccactgcaccccagcctgggcaacagagcaagactccatctcttaaaa

SEQ ID NO: 447288 - DNA, 8412 bp, Homo sapiens
  misc_feature (2128)..(2128): n is a, c, g, or t
  misc_feature (2285)..(2285): n is a, c, g, or t
  misc_feature (2293)..(2293): n is a, c, g, or t
  misc_feature (2331)..(2331): n is a, c, g, or t
  misc_feature (2383)..(2383): n is a, c, g, or t
  misc_feature (2385)..(2385): n is a, c, g, or t
  misc_feature (3991)..(3991): n is a, c, g, or t
cgcactcaattaaggtaatggtcctctgggtataaaaggtcaatttcttcttgccgcttttaagaataatcatctttgggtttcagaagtttaactgtgacatgaataggtacggttttccctcccgttatcccgcttgggaattttttgggtttttgcgtttttaaattaagcttttacttttttgaggtaatccctgagggccctcccgcgatatcctccacacacggcaagctcataaagaaagggttaaaaaaattaaaaggactcggccaatcttaccccgcctgtttacccaaaacatcacctttagcatcaccagtattagaggcaccgcctgccccgtgagccaagattacacccctgcaccccagcattggcgacaaaatgaggccattctcaaaaaaaaaaaaaaaaaaagctatggttactcttctcaaaaaatgcacggaaagtcacacaattttacatacagttttaaagggttcacagacccctggggagtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447289 - DNA, 8413 bp, Homo sapiens
  misc_feature (2129)..(2129): n is a, c, g, or t
  misc_feature (2286)..(2286): n is a, c, g, or t
  misc_feature (2294)..(2294): n is a, c, g, or t
  misc_feature (2332)..(2332): n is a, c, g, or t
  misc_feature (2384)..(2384): n is a, c, g, or t
  misc_feature (2386)..(2386): n is a, c, g, or t
  misc_feature (3992)..(3992): n is a, c, g, or t
ggaaagggttgaaataaatacacttgaaaagtgggtcaggatcaatgaaagtgagaggtaagttggtggttcttaatcttctttggataaccctcaaagaacctcgtgaaagctgtggttacagctgggcacggtggctcacacctgtaatctcagcactttgggaggctgagaggccccggatcacccgaggtcaggagttcaagaccagcctggccaacgtggtgaaaccccatctctactaaaaatacaaaaattagctgggcgtggtggtgcacacctgtagtcccagctactcaggaggctgaggtaggagaatcacttgaacccaggacagaggtcgcagtgagccaagattacacccctgcaccccagcattggcgacaaaatgaggccattctcaaaaaaaaaaaaaaaaaaagctatggttactcttctcaaaaaatgcacggaaagtcacacaattttacatacagttttaaagggttcacagacccctggggagtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447290 - DNA, 1341 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccctaaagtaaccggttacctgacgttcactgtactaggtaaattgaccccttagacacttctactctctgcggtttgcacagtctccattaccgaagggcaacttctaaactatctaaagaatg

SEQ ID NO: 447291 - DNA, 3866 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtgagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447292 - DNA, 3311 bp, Homo sapiens
cgcactcaattaaggtaatggtcctctgggtataaaaggtcaatttcttcttgccgcttttaagaataatcatctttgggtttcagaagtttaactgtgacatgaataggtacggttttccctcccgttatcccgcttgggaattttttgggtttttgcgtttttaaattaagcttttacttttttgaggtaatccctgagggccctcccgcgatatcctccacacacggcaagctcataaagaaagggttaaaaaaattaaaaggactcggccaatcttaccccgcctgtttacccaaaacatcacctttagcatcaccagtattagaggcaccgcctgccccgtgagccaagattacacccctgcaccccagcattggcgacaaaatgaggccattctcaaaaaaaaaaaaaaaaaaagctatggttactcttctcaaaaaatgcacggaaagtcacacaattttacatacagttttaaagggttcacagacccctggggagtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaatgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447293 - DNA, 966 bp, Homo sapiens
  misc_feature (778)..(778): n is a, c, g, or t
  misc_feature (780)..(780): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgaaaaaaaaaaaaaaaaaaaaaaaaaaacancnacacacaaaaaaaaaccacaggaacaacatgcccgaggggagaaaacagggtgaaaaaaacggcagagggggccagacgcgcagagccacgagaacccaatcacggcgacccacggggcacacaacgggcgagacccccacaaaagagggccggcacaaacaccgaacaccgggtcacgacggcac

SEQ ID NO: 447294 - DNA, 705 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtatgtattactacttaagccttgattcttattggtctttctgactaatatatcgttcagatcaatgatatagtatatttgatcggttaactagaaagcatataaactttaatttcataaatactaaatctataacaattctaagcttttcataatgatctgaataaatatttcaccttctagccatatgtaatgctatttttattttag

SEQ ID NO: 447295 - DNA, 630 bp, Homo sapiens
gtttgggtttcagtcagatttaaaacttgcacctggtctgaaaacaagaaggcaagtttgatcagggccgtaggtgaacagcgggatactcttcttggcgacgctggcaacttgcagctcgggccgaatcggcacgaggttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447296 - DNA, 8117 bp, Homo sapiens
  misc_feature (6)..(6): n is a, c, g, or t
  misc_feature (1833)..(1833): n is a, c, g, or t
  misc_feature (1990)..(1990): n is a, c, g, or t
  misc_feature (1998)..(1998): n is a, c, g, or t
  misc_feature (2036)..(2036): n is a, c, g, or t
  misc_feature (2088)..(2088): n is a, c, g, or t
  misc_feature (2090)..(2090): n is a, c, g, or t
  misc_feature (3696)..(3696): n is a, c, g, or t
aggcgnagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447297 - DNA, 8039 bp, Homo sapiens
  misc_feature (6)..(6): n is a, c, g, or t
  misc_feature (1755)..(1755): n is a, c, g, or t
  misc_feature (1912)..(1912): n is a, c, g, or t
  misc_feature (1920)..(1920): n is a, c, g, or t
  misc_feature (1958)..(1958): n is a, c, g, or t
  misc_feature (2010)..(2010): n is a, c, g, or t
  misc_feature (2012)..(2012): n is a, c, g, or t
  misc_feature (3618)..(3618): n is a, c, g, or t
aggcgnagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447298 - DNA, 8151 bp, Homo sapiens
  misc_feature (1867)..(1867): n is a, c, g, or t
  misc_feature (2024)..(2024): n is a, c, g, or t
  misc_feature (2032)..(2032): n is a, c, g, or t
  misc_feature (2070)..(2070): n is a, c, g, or t
  misc_feature (2122)..(2122): n is a, c, g, or t
  misc_feature (2124)..(2124): n is a, c, g, or t
  misc_feature (3730)..(3730): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447299 - DNA, 8169 bp, Homo sapiens
  misc_feature (4)..(4): n is a, c, g, or t
  misc_feature (101)..(101): n is a, c, g, or t
  misc_feature (1885)..(1885): n is a, c, g, or t
  misc_feature (2042)..(2042): n is a, c, g, or t
  misc_feature (2050)..(2050): n is a, c, g, or t
  misc_feature (2088)..(2088): n is a, c, g, or t
  misc_feature (2140)..(2140): n is a, c, g, or t
  misc_feature (2142)..(2142): n is a, c, g, or t
  misc_feature (3748)..(3748): n is a, c, g, or t
tgtnagggaggtttcttcgtggccgcagttctcggggcggattccgaggaggcaggggcaatgggaccacccgtcgcaaccccacttcccacagggccggnactggcagggtgtgagggtgcagccaaaggctcctactgaagtggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447300 - DNA, 1092 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccaaaaaaaaaaaaaaaaaaaaaaaaaaaccctcgtgccgaattcggcacgagctcgtgccgaattcggcacgagaaataacagagaaactgttatatctttttaatgatttatttgcaagtattgagatttgacctgaaaaacaatgaaacacatgaaccacacttccgattttcttcctcgctgattagccttcctgccctgctgtacagtgcttggaacaaaatggcttttaacctacttttatggtaacaattaccagaaaccagctttgagggtcc

SEQ ID NO: 447301 - DNA, 1014 bp, Homo sapiens
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccaaaaaaaaaaaaaaaaaaaaaaaaaaaccctcgtgccgaattcggcacgagctcgtgccgaattcggcacgagaaataacagagaaactgttatatctttttaatgatttatttgcaagtattgagatttgacctgaaaaacaatgaaacacatgaaccacacttccgattttcttcctcgctgattagccttcctgccctgctgtacagtgcttggaacaaaatggcttttaacctacttttatggtaacaattaccagaaaccagctttgagggtcc

SEQ ID NO: 447302 - DNA, 9132 bp, Homo sapiens
  misc_feature (1981)..(1981): n is a, c, g, or t
  misc_feature (2138)..(2138): n is a, c, g, or t
  misc_feature (2146)..(2146): n is a, c, g, or t
  misc_feature (2184)..(2184): n is a, c, g, or t
  misc_feature (2236)..(2236): n is a, c, g, or t
  misc_feature (2238)..(2238): n is a, c, g, or t
  misc_feature (3844)..(3844): n is a, c, g, or t
  misc_feature (8602)..(8602): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaaaaaaaaaaaaaaaaaaaaaaaaaaaacaaaaaaaaaaaaaaaaagaggggcggcgcgcgcggcaaaaaaattccccccgggggggcccacatttctaccgcgccccccttttttttttaaaaggggggcccccaaaatagggggggcttattatataaaacaaggagcgggggcgcggtttaaaaaaaacggggagcagggaaacacaacgcagtacaagtgagaaatcctgagtgagagaggcccacctatcttcggggggggcgagcacacaatgtgggagcccacactccctcagagagtatataagagccgcagtacggaataaaatctaccntggaaagggtaactcgggggtgcgaccaccacacggaaaaattacgctggagcggtgaaagagagtttgcggacacacgcgaagatcatatactgacacaaacttttctccaggcgggcgcatgatctaacaacaagaaaaaataggttagtacataggaaagagagggaaatcaaagcgatagagtacgtaatcacagataaaagaagaaagagaaaggaacagaaaacaaagaggatagatagagcgaaactagacagcatagagaagatacaaaaaaaagacgaggactaacacagaaagaagcaaaaacagaaaaacaaaaaacagacgaagaaaaaagaaaagtaaaagaacaacagagaatagacagcagtaacaaaaataaaagacagagcagagcaagaagatgtaagtaagagctagaagatatagcacaaacagacaggcatagaaaacagacatgaggaacgataagacataggaaaaaggaagaaacgacagaagaagataataacaaccgaatcagt

SEQ ID NO: 447303 - DNA, 8265 bp, Homo sapiens
  misc_feature (1981)..(1981): n is a, c, g, or t
  misc_feature (2138)..(2138): n is a, c, g, or t
  misc_feature (2146)..(2146): n is a, c, g, or t
  misc_feature (2184)..(2184): n is a, c, g, or t
  misc_feature (2236)..(2236): n is a, c, g, or t
  misc_feature (2238)..(2238): n is a, c, g, or t
  misc_feature (3844)..(3844): n is a, c, g, or t
tggggttcgaaccagcaagacaagcgggcatggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttcctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacacttcgggagaccgaggctggtggaacacttgaggtcaggagtttgagaccagcctggccaacatggtaaaacgccgtctcggccaggcgcggtggctcacgcctgtaatcccagcactttgggaggccaaggtgggtgaatcacgaggtcaggaaatcgagaccatcctggctaacatggtgaaaccccgtctctatttaaaaaaatacaaaaaattggccgggtgtggtggcacgcgcctgtggtcccagctactcaggaggctgaggcatgagaatgacgtgaacccgggaggcggagcttgcagtgagccaagatggcgccactgcactccagcttggcgactgagcaagactccctctcaaaacaaacaaaaaaaagtctctactaaaaatacagaaattagccaggcatggtacacacatgttgtcccaactacttggggcactggggcacaaaaaatcacttgaacccaggaggcagaggttgcagtgagccaagatcacgccactacactccagcctaggtgacagagtgngactctgtctcaaaaaaaaaaatcccaacttttagtagtctcttagtcatgcaataacagtaatttgtacaatcttttaaaaattatatttatttatcagtttctaagaaacttttttgtttgttttgagacaggctcttgctcttttgcccaggtngaagtgcngtggcatgatcctggctcactgcagcctccacctctcnggcccaagcaatcctcttacctcagccctgcaaatagctgggaccacaggcncntgccaccatacctggctaattttttttatttatgtaagagacagaggtctccctatgttgcccaggttggtattgaactcctggctcaagccatcctcccaccttggcctcccaaagtgctgggattataggcataagccaccatgccctgccctaagtaactgttacttgagttaatgtactagttaattgacccttagaaaattatatttttctgcttgcaagtcttcattaaagaaggaaattttaaaatattttatagtataatgctatccaaactcatttttaaaaacattttattatggaaattttcacaaatgcacaaaaagaatagcagaatgaagctctgtgtacccatcctccaacagctgtcctgtggtcagtcttgtttacctgcatccccacctatcccctgccccaacccacagggatcagtttgagtcccattaacaggcatagtattttcatgtttgtgtgatcagagacattcaaatataactccaaagatagggtacttttttgaacataaccacaataccattgtgtaagactgctaaaacattttttgatgccaagtaccagtcaatattcaaacttcctgattgtctcgtaagttttttttaacagttggtttattcgagtcaagatccaggcaagatctagatcttgcattttgttaatataatctatagatttaactttcctgtttttaatttttgaagaaactaagttgtttgtcctatagaattgtccttcagtggattttactgaatgtatcctaatgggatcatgtacaccttttctgtcccctatatgttctataaactgacagatctagagggcttctgttgttctgttttgctttttcacaaaaataattcataggtgatatatgctccatgttgtatcacatcatggcacataatggctctcatcttgtaacattaagattgatagtgggtttggatgctgccagcccactccattcattacaaaagttctctatcagcttttcccctgatggatttagccatcattaatgatatttgcccacatctgggattccattagaggttgccaaccagtgatatcttgtcattccttctgcatctattagctggaatcctataaagaacttgtgctcattaattcacgaggcaggataaaatagaaatttcaaattctgattgaataggcgcccattttgaagtttctgtattgagagtcaggcctacagtaaaagtagcaatagaaagctgattgtttgaaaaaaaagaagcgggggggggagtgcaatataatcaacagactttcctttggctgaatcacttgattcagggcaatttttactacagttttatagataattgcttcaaatgtctaattcattttgatagtatagttacttgactacataatttcttcccagggttgtattttcaatttgttttctaacaaaaaacatagaaatagaacaactaggtcatgtactctgggcttagctctcacagttatgatcagtctcgtttcatttgtacccaaccccttgagttattttaaagcacgttccagctatcatatcacttcatgtataatatcttaatangtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacaacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagcttttttttttttttttccttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggcgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 447304 - DNA, 2378 bp, Homo sapiens
gcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatcagctgagatcacaccactgcactccagcctgggtgacagattgagactccctctcaaaaaaaaaaagaaaaatcattgaacactcgtggaaccctaggtattgctatttccatttacagttgaggaatccagggctcaagtcctcgcagccatgtctgtctggataaaggcctggactctttctcatctccatccttccctctgatttacctctcattgtacagtcactcttgcggattgaggaagggagagcagagcctcaggacagcctcctgccattgacttccataatgtatatattttggatgcagacaatgataatttgagctcatttatgtgaagtgcattgactttgcaataaaagtaatagtatttcattgtccttcgtctttgcatgggctattccatcatcgaaggcacacttactctctccttatctctctccccaactgctcctctctctgtggaaataatcccgtttggcccttcccatgggtcctctccacatcagagcagtggccctaatctccctaaccatggagcagccctgcagcctggtctcaccctgggcatcatgctccttcccatttggctcagaaaaggattcccttcctctctaaggaatcttcccatctcatttgggaccatccagcccttaaattttcccaagaaatctctgtgagtgtcccctgacataccatagctcccctttcaccctgaatcttttccaccctctggtcaaagggaaccccacgatggatcccttctttacagattcata

SEQ ID NO: 447305 - DNA, 473 bp, Homo sapiens
gcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaacgattaagcatgaaaatattgttgccctggaagacatttatgaaagcccaaatcacctgtacttggtcatgcagctgtaagtaccttgtttgattgatgagttttgaaccaacttgcaaactccaatgtctaaagggatcaggtgggaaaagaagtgattgaagtgggccaggtaaggcagtagggagcagggaggcctgtgggatactagagag

SEQ ID NO: 447306 - DNA, 1948 bp, Homo sapiens
agcggatgaatttgatgactttggacacctcctcggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 447307 - DNA, 1251 bp, Homo sapiens
taagactcccctttatgggacgcagtgtcagggcccagaagaagcacttcagagcagcacctttgcctctgtttcaggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 447308 - DNA, 2174 bp, Homo sapiens
gcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 447309 - DNA, 1783 bp, Homo sapiens
ggtggctgcccccggcactgggatggttgctcagtagcacgtcgccagggtggagatcggcccccaggtgctgaatcagcaatgctcatgaagcggtgtgagaagatggacagctggatagggtccagctgggggcccactgtgccggggacttcggcccccacggagatgcagatgtcccctgtcttggtcacctctgcctggcaacctggctccaccaggatggtgctgttacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtgagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 447310 - DNA, 376 bp, Homo sapiens
caagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaaagcaaactctgacaaagcccacaacaacatcttcagattgtctctactttgttctcagagtgaatttcttcttccttgtataatgctcctatcttttaaagcaatcacagtcttttaatgagtggggattcagagcagcacttaacagtctagatgttt

SEQ ID NO: 447311 - DNA, 5955 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttccttctctcttcccgtcttctctcctct

SEQ ID NO: 447312 - DNA, 5901 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttccttctctcttcccgtcttctctcctct

SEQ ID NO: 447313 - DNA, 6563 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaatactaagacaatttgttgcctatggacgtctgccttacaagaaatactaaatccttcacacagaaaataaatgacaccagatggtaacctgaatccacaggatgaaatgaa

SEQ ID NO: 447314 - DNA, 5955 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagccgtcgacggcttcaacggaactttatccaggcaaacatgggatgtcaagagtggcctgtggtactggagacaaggaatatcaagtaattgacatgttacttgtctgtcagattttaagaatactgttatttaggcatattcaaagaaacaactgcctgttttaatagggataagtatataacgaacacatttatatccatacgccctcaaaagccttattcc

SEQ ID NO: 447315 - DNA, 4391 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgatgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttccttctctcttcccgtcttctctcctct

SEQ ID NO: 447316 - DNA, 834 bp, Homo sapiens
ggtcaagggggcagagcgttggggtgaatggaacccggccttaaggtgtgactttagccttagatgtgtcgaccgtaacgttcagcgcattacccatctggtggagatgtaactgtcgaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttccttctctcttcccgtcttctctcctct

SEQ ID NO: 447317 - DNA, 1441 bp, Homo sapiens
actttaaacgtaatgatcaattttgagggacagaggtgtgaatgttttacaatacccaactttaaaaaaaatctattataaaaactgcaactcatctccctaacatttttaaatggtggtattatgtttgcacaaacagattaatacattaaattaagccaagatcttaaagactggcaaagttctatcattctattttaaatacaaagatgataaaaaaaaaaagttagtttgcttcatgttacatttcacaaccattatgttaaatgttttcttttctacagaaacagggtcctttatatcacaactgcaagtatttactgctagatgtttaaagttacacagactagtgttcaactggagcctgctgatggtgatgtcttgaagttttctgaatgtcaacctaaggtgtgccaggtcctctcctaggaccactcttgcaggggaggagggagaagaaatcacagatcaagctcttaagattgtttcactctcttcgtggctttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaatactaagacaatttgttgcctatggacgtctgccttacaagaaatactaaatccttcacacagaaaataaatgacaccagatggtaacctgaatccacaggatgaaatgaa

SEQ ID NO: 447318 - DNA, 937 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtaacataattgtttctcctttttcctaagacatctttttaaaattaagcgatacttattttattagttttctaataagccaacttgctagaatgtgagatagtataaataatattgcaggtttgaacctaataaaaatctttaagtttgatgtatatatgactgtggctggtttaaaatagattggaacttaactttaactgttaaagcgaatcaataagtcagctccatggtggtataaatttcaaagcgttctcacttgtataatctaatttgcttttcatcac

SEQ ID NO: 447319 - DNA, 523 bp, Homo sapiens
acaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctc

SEQ ID NO: 447320 - DNA, 6586 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaatactaagacaatttgttgcctatggacgtctgccttacaagaaatactaaatccttcacacagaaaataaatgacaccagatggtaacctgaatccacaggatgaaatgaa

SEQ ID NO: 447321 - DNA, 6473 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagaca

SEQ ID NO: 447322 - DNA, 5901 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaacttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttccttctctcttcccgtcttctctcctct

SEQ ID NO: 447323 - DNA, 3583 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagaatgagttgagaggttgtttatagtggttgtctaaataatactctc

SEQ ID NO: 447324 - DNA, 489 bp, Homo sapiens
tgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtgg

SEQ ID NO: 447325 - DNA, 3311 bp, Homo sapiens
tttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccaaaaaaaaaat

SEQ ID NO: 447326 - DNA, 3218 bp, Homo sapiens
tttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccaaaaaaaaaat

SEQ ID NO: 447327 - DNA, 3000 bp, Homo sapiens
tttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttatcgagctcgataaggggccaaacgatagtctcctaagtgttctccttgtttccttttggcaccaattaccccccatcctggccccaccagaaaatctctggtcttttcttaacacagaattcagagtttaaatgtaggtcagaccatgtcattcctgtgcctaatatcccctttggacattatctcttagaggaaaaa

SEQ ID NO: 447328 - DNA, 543 bp, Homo sapiens
aacccctgagctcaggcaatccgcccgcctcggcctcccaaagtgctgggattacaggcgtgagccactgcacctaaccctgtcttgtttgtttttgacactgcagtgaagcttttagggaagatttttagttcctcgtaggcacttttctggattctttcctaaagttaaggttgaatacctttgagtagtttgagataaaaagtattgcttcttctgtatatcttcatctttgaaagtttataaacttaacacctttttctgttcattgtatcagagaatctgaaaaaaaaacatttctgctgcaggtacagaggggccaggtgtaagcatctctgaagagagacaaagtctggctgaaaactctgggacaacggttgtttacaacccttatgctgccctttccatagagcagcagaggcagaagctgccggtattcaaggtacgtcaaataatcatgttcaacctgtgggcttgaatcgtgtgtctgcattagctttatgctcagcactgaagggaatgatggcctctttctagaacaca

SEQ ID NO: 447329 - DNA, 815 bp, Homo sapiens
cggacgcgtgggtcgggctgcgcccgtgggaccggtgaaggttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacacatgatctttcttcccaaaggttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacgtaagagccttgcctcccctttcctcctctcctcacaaacacttttgtcctatatatccttgggaagttacctctagcaagagcttatctttggcagaatgccctatcttctttatgggaccatctgatgtcctagatt

SEQ ID NO: 447330 - DNA, 1975 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447331 - DNA, 609 bp, Homo sapiens
  misc_feature (35)..(35): n is a, c, g, or t
aattcgcggccgcgtcgatacggctgcgagaagcnacagaaggggggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447332 - DNA, 2350 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447333 - DNA, 2714 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447334 - DNA, 2156 bp, Homo sapiens
ccttatggccggatccggcctttatggcacgaacagtgccccccccccccgacatctattgaaagggtaacgacagacggagatcaactaaggtggcaggtaaggttcagaaaaggagaaggacaacaaatttggagaaataggagaagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447335 - DNA, 2263 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447336 - DNA, 1254 bp, Homo sapiens
ataaagtcaaattcagcatatgtttttatttttaggcttgacttttacaagacattaatctccatttgtaaatatctttcaaagactcaggtggtgtgcacccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447337 - DNA, 1344 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaactgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447338 - DNA, 2190 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccacttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447339 - DNA, 870 bp, Homo sapiens
ctcaatctctcccatctgtgtcccctgccttcacgaaacagaggagaagagagaggttgcctctgcttaaaacacaagtggcttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447340 - DNA, 928 bp, Homo sapiens
  misc_feature (30)..(30): n is a, c, g, or t
  misc_feature (65)..(65): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (92)..(92): n is a, c, g, or t
  misc_feature (103)..(103): n is a, c, g, or t
  misc_feature (110)..(110): n is a, c, g, or t
  misc_feature (114)..(114): n is a, c, g, or t
  misc_feature (119)..(119): n is a, c, g, or t
  misc_feature (124)..(124): n is a, c, g, or t
  misc_feature (127)..(127): n is a, c, g, or t
  misc_feature (134)..(134): n is a, c, g, or t
  misc_feature (139)..(139): n is a, c, g, or t
  misc_feature (157)..(157): n is a, c, g, or t
  misc_feature (170)..(170): n is a, c, g, or t
  misc_feature (173)..(173): n is a, c, g, or t
  misc_feature (210)..(210): n is a, c, g, or t
  misc_feature (232)..(232): n is a, c, g, or t
  misc_feature (236)..(236): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (307)..(307): n is a, c, g, or t
  misc_feature (319)..(319): n is a, c, g, or t
  misc_feature (324)..(324): n is a, c, g, or t
  misc_feature (336)..(336): n is a, c, g, or t
  misc_feature (352)..(352): n is a, c, g, or t
cgttgaaaggtcatggggaacaacaggatngggaagaagatttgagcctcaattccaggctcttntgtttgtgttnaantatnggtaatatntgtcattggtnttttgtngcancagtnttcanttnttggganttttntcagtcttttggggatgnatctcgcctttancanaatgttcctgcttttggtttaggtatttgggcattangtttttttctaattatatgtcncatnaatatggcggtattattattatccacattagnggnttangatgctgttatgctttagttgttaggcgattntattatcatatntcttnttctcttccttnattttgtatatgttgntctatccatgtgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447341 - DNA, 634 bp, Homo sapiens
atttttagaaaaacagagcaaagtttattgaaatttcaagctacatttggaaaatcaaaatccaaatccgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447342 - DNA, 1892 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaagggaaggcttttgatcacatggcacctgggacgcttccccaaacgcttgtcctgaacggccttgtgagattgacaccctccaccttgtagcctttaccccggcgtttcttccggacttgcatcttgccctctgcacgactttaccactccacagctcccg

SEQ ID NO: 447343 - DNA, 788 bp, Homo sapiens
agcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcgcttggtccttctgccctccaggtggccatacgccctataccttggcttcaccagccctttcccagtcgctcctccctccccagcctcattccccgaggggactctacccctctccct

SEQ ID NO: 447344 - DNA, 437 bp, Homo sapiens
atctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctca

SEQ ID NO: 447345 - DNA, 420 bp, Homo sapiens
tccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgg

SEQ ID NO: 447346 - DNA, 1975 bp, Homo sapiens
agcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447347 - DNA, 2165 bp, Homo sapiens
gctaggaggaggcgcgggttaatcggcaacgagggaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447348 - DNA, 2098 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447349 - DNA, 1888 bp, Homo sapiens
agcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447350 - DNA, 1921 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaagggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 447351 - DNA, 1560 bp, Homo sapiens
  misc_feature (5)..(5): n is a, c, g, or t
aacanagctggctggtacggtccggcattcccgggctggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggcatccgtggccgcattcaaaggctggcccggcacgag

SEQ ID NO: 447352 - DNA, 568 bp, Homo sapiens
tgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggaccc

SEQ ID NO: 447353 - DNA, 608 bp, Homo sapiens
aggttaagcatgaagtataggaagtatgcaggataaaaataagcattagatgattcataatttataacatggggaataagaattattagaagttgaatgtggaagatgaagcttgaaataaaatttttattttgttttgaattaaatcaaccatgattattcacagtgcagtaagtgtgtatcatctgtttgatattttcatattacagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggtaagtcttccacttgtaggagcaattgacatttcacggagtcttgatgtgttttaaatgaaggtgtgctctggtatgtaatgacaatatgtgaacaaacctgtggaattaaagttaaaatgaaatagtcaatttgatacagtggaaaataactaagcatacacaatactggtgaggctggtgaaacagggatgttgaatgca

SEQ ID NO: 447354 - DNA, 1227 bp, Homo sapiens
agcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacgttcagcaaaatacaataagtgcttagcttgatcttctagctctttgaaaattggatttttatcctggtggttgagttctggtgttcagctgaacgtggttttgttttaaattctactttttaaaaaacatttattagcttgttccttttctacttcacgcctcttccttcctccaaccccaaatagcctaagacaatggagccatagagcccaacacttggtctatatacagcagtccactttctaggcaaatgcagttttaaaactgtgccataggccaggcgccggtggttcacgcctataatcccaccactttgggaggccgaggcaggcggatcacaagatcaagataccgagaccatcctggccaacatggtgaaatctcgtctctactaaaaatacaaaaattagctggacgtggtggcatgcgcctgtagtcccagctactcaggaggctgaggcagcagagtcgcttgaactcacgaggcggaggttgcagtgatgtgtcacgccactgtactccagcctgatggcagagcgagactccatctc

SEQ ID NO: 447355 - DNA, 808 bp, Homo sapiens
ttttgagtaacaatataaacgagtttagtggttgctttggtttaagatgtattcttcggttagcatttaaaagtacagttctaagtttaatttacttttgtattacttttaaaaaacagatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggtaaacaaacaaaacataaagggagaaaacttaagacataaccatttctaatatttggagtttaaattacttttcaatagcaaaccttaagctcaggtgtttgtgtttcctttaacatttttcttttaaaaagtgtattaaaacctttctgagcatctactgtcttattaggcattgttatactttataagtgacatctcatttacccttctggaataattaatattttagggattttacagtttagtagctgtaaactaagtagagctaagatttacattaagttctgtctgatatacaatttttgcttcattaagtgaaaattacctacaggatgacaatttagggatattttaaagaagagttttctgataactattgtctgaaagtagaagggattgtattttgagatagtaaggttttc

SEQ ID NO: 447356 - DNA, 8095 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447357 - DNA, 7826 bp, Homo sapiens
  misc_feature (5221)..(5221): n is a, c, g, or t
aagagggcagaaacaatccatgttgcttctcttccaattcagtcctcccactgcttggcttcagatgtagaaatgcatggtagagccagataccgaaagcctgttttctgcttggaagactaaaaagagaagcctcagcaaatgaaagcaacagggtaattgctgagagagagttaatcagtgaagcaaccccattaacctgtctataaaccccagggctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactctggacactgaactgactttggaaccagactgcagaatggaggggtgggaacttgtggcttgaacctaatcaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447358 - DNA, 5631 bp, Homo sapiens
  misc_feature (3026)..(3026): n is a, c, g, or t
gagatggagtcttgctctgtcaccaggctggagtgcagtggcacgaccttggctcactgtaacctccgcctcccgggttcaggcgattctcctgcttgaacctgcacggcagaggttgcagtgagttcactggtattaaggtggtttagttattacagtatttggaagttgaacaaatgactattgaggtaccatttggttttgacttgaaattttagccagttcttacaacttgtaaatgaactttagatctaatcatgcgtgttccttaaagttgtgtgcttttaactttcttttttagggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447359 - DNA, 5309 bp, Homo sapiens
  misc_feature (2704)..(2704): n is a, c, g, or t
gcagtattgtcattttgaaatggcaatttaccattattattaaatttttatttctaaatgcttctcaaaatacatatcaaatctattagtcctcctccaaaatatcatttgtcatccctgatgggagaagacttgctcgcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447360 - DNA, 8041 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaataggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447361 - DNA, 8041 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaattctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447362 - DNA, 2287 bp, Homo sapiens
aagaaagcagacctataaaatatcacatagtaagatatttatatttagatttttcttatttagaatcttcatctgtaatgtatgattttgaaaattaattcttggaacaacatcttgcagagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447363 - DNA, 2300 bp, Homo sapiens
ctttaaagttccaaagaatttattatcaaaactaaaacaaaacttcagttgtacataaagtaataaactttacaacagctgttaagagaaagtcgtgatgtaagtttatacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447364 - DNA, 2299 bp, Homo sapiens
agcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447365 - DNA, 6386 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttac

SEQ ID NO: 447366 - DNA, 7023 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacgttcagcaaaatacaataagtgcttagcttgatcttctagctctttgaaaattggatttttatcctggtggttgagttctggtgttcagctgaacgtggttttgttttaaattctactttttaaaaaacatttattagcttgttccttttctacttcacgcctcttccttcctccaaccccaaatagcctaagacaatggagccatagagcccaacacttggtctatatacagcagtccactttctaggcaaatgcagttttaaaactgtgccataggccaggcgccggtggttcacgcctataatcccaccactttgggaggccgaggcaggcggatcacaagatcaagataccgagaccatcctggccaacatggtgaaatctcgtctctactaaaaatacaaaaattagctggacgtggtggcatgcgcctgtagtcccagctactcaggaggctgaggcagcagagtcgcttgaactcacgaggcggaggttgcagtgatgtgtcacgccactgtactccagcctgatggcagagcgagactccatctc

SEQ ID NO: 447367 - DNA, 3193 bp, Homo sapiens
  misc_feature (3080)..(3080): n is a, c, g, or t
  misc_feature (3099)..(3099): n is a, c, g, or t
  misc_feature (3107)..(3107): n is a, c, g, or t
  misc_feature (3167)..(3167): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactggatttttcacagggaaangggcagaaagaacatttgnaaaattgnatggcccttttctccttggaaagaaaacaaagaaagaaatgccaagaaaatttatcttgnaccaaaagaaccaagggggaacttac

SEQ ID NO: 447368 - DNA, 1836 bp, Homo sapiens
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggtaaacaaacaaaacataaagggagaaaacttaagacataaccatttctaatatttggagtttaaattacttttcaatagcaaaccttaagctcaggtgtttgtgtttcctttaacatttttcttttaaaaagtgtattaaaacctttctgagcatctactgtcttattaggcattgttatactttataagtgacatctcatttacccttctggaataattaatattttagggattttacagtttagtagctgtaaactaagtagagctaagatttacattaagttctgtctgatatacaatttttgcttcattaagtgaaaattacctacaggatgacaatttagggatattttaaagaagagttttctgataactattgtctgaaagtagaagggattgtattttgagatagtaaggttttc

SEQ ID NO: 447369 - DNA, 391 bp, Homo sapiens
cctgtcttttttccccgttctgctgtcttatgtagatactgagaatattaaacctgtactcttttcatttgctacataagcacccattttgttgtccagctgtattttttgggttggagggttaggtttgcaataatcatgttatttcccctttgggtatacaaatgagacaacgtgagcaaatacaatctgtatttttaaagtgatggaaataacttaaatttttttttcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattgga

SEQ ID NO: 447370 - DNA, 355 bp, Homo sapiens
catgaaataaacactctaagagcccaggaaaaacatggccttcaacctgctctgcttgtacattgggcaaaataccttcagaaaacggtgagttttaaagtataagcatttttaatgaacattaccttaattttttaaaatcatgaactttttattgaaagtttttttgttctgaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaatt

SEQ ID NO: 447371 - DNA, 373 bp, Homo sapiens
tgtaagcgctgaactgtgtatttagaaagcaattttagtaaattgaactattttttagacctggaaacttggcaaaattgagacttctagttcagcatgaaataaacactctaagagcccaggaaaaacatggccttcaacctgctctgcttgtacattgggcaaaataccttcagaaaacggtgagttttaaagtataagcatttttaatgaacattaccttaattttttaaaatcatgaactttttattgaaagtttttttgttctgaaaacagcagcttggtcatattatgacagatgtgttttttattgctgcaaaatagttaatgtagttaaatataagcacttagaggagcaatgcctggcacacag

SEQ ID NO: 447372 - DNA, 3507 bp, Homo sapiens
aagagggcagaaacaatccatgttgcttctcttccaattcagtcctcccactgcttggcttcagatgtagaaatgcatggtagagccagataccgaaagcctgttttctgcttggaagactaaaaagagaagcctcagcaaatgaaagcaacagggtaattgctgagagagagttaatcagtgaagcaaccccattaacctgtctataaaccccagggctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactctggacactgaactgactttggaaccagactgcagaatggaggggtgggaacttgtggcttgaacctaatcaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatc

SEQ ID NO: 447373 - DNA, 6593 bp, Homo sapiens
  misc_feature (3988)..(3988): n is a, c, g, or t
ttgcgatggagtctcgctctttcacccaggctggagtgcaatggcgcagtctcggcgcactacaacctctgcctcccaggttcaagctatccttgtgcctcagcctcccgtgtagctggaattaataggtgtgtgccaccacgcctggctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagataagaccatgttactattagaagtatgggtatcatcaaattaagatttttgattctaaaattattaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447374 - DNA, 6408 bp, Homo sapiens
  misc_feature (3803)..(3803): n is a, c, g, or t
agtggattcacaactaattaagctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagataagaccatgttactattagaagtatgggtatcatcaaattaagatttttgattctaaaattattaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447375 - DNA, 4183 bp, Homo sapiens
  misc_feature (1578)..(1578): n is a, c, g, or t
cctattagacatcatcatctttctcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447376 - DNA, 8328 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatatttttatggctgctcttttatgttacccactgtctctttggggttgttaattggtttctgaaagggaacttcaaactcctttactactggccttccatggttggtccctattaggtttttgtgagaacgtcgaccaactctttgatacccgccaggtagaccgtagtacctgccatgtctgacaccctgcatccaagctaaaaccagaaacagcgctgggcctccctgtggacaagtat

SEQ ID NO: 447377 - DNA, 3421 bp, Homo sapiens
  misc_feature (816)..(816): n is a, c, g, or t
gctagtcggccctgcactacaacgttcgaacgtttcgtataagacatcgctgctccttcagagtgatacgtaatgatcaagcgcttgtattgtgctggcccaccaatcctataggcctcaactagcttaaagtcagctcgcggactgtctctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaactaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 447378 - DNA, 6354 bp, Homo sapiens
  misc_feature (5490)..(5490): n is a, c, g, or t
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctntattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttagatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtacggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcac

SEQ ID NO: 447379 - DNA, 2042 bp, Homo sapiens
gatcacagctcctgcatggatcaaggagcatcactgcagctgcaaactgcagcttcaaactctccggctcaagcgaccctcctgcctcaacctccccagtagctgggcctacaggcacgtgtgtctgtgcccaataataccacattttaaaaatccatcttcagtagatggaaatttggattgtttccaccttttactaataaaaatagtactgctataaacattcatgtataggttttcttttgtttttgttttttcttttttgtagagatgggggtctcgctgtgttgcccaggctggtctcaaattcctggactcaagtgatcctcccatcaaaaactcccaaagtgctgggattacaggcgtgagccactatgcctggcctgtatacaagtttttgtgtagacatgtttacatccaattaatgaacacaggatgtctttccattgatttagctcctctttaatttccttcaacagtgttctgtagtttccagtctacaagtcttacacttttgggttaaatttattcataattattttattatttttgataatattataaatggaattgtttacttaattttacttgaattgttccttgctggtgtataagtagacatctcatttttttagttgacctcgtatggtacaatctctttgaactcatttattatcactgatagtttaggtctttttttttcgaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggtaagtcttccacttgtaggagcaattgacatttcacggagtcttgatgtgttttaaatgaaggtgtgctctggtatgtaatgacaatatgtgaacaaacctgtggaattaaagttaaaatgaaatagtcaatttgatacagtggaaaataactaagcatacacaatactggtgaggctggtgaaacagggatgttgaatgca

SEQ ID NO: 447380 - DNA, 5685 bp, Homo sapiens
tcatttttgagattgagttaccatggagggaaagaacatgtgttttaccagtggaacgcattctttgtgttatctcttcgatttttaacattttatgtttccagtttataaactttgcctccagtttgatgaagaaaatttagctattagaaagtatttaaaatctcaaaagtatgacattttaaaatgttagcaggtttaaagataacttagtttttcaactcttaacccaaaattatacttgtatactataatttgtgttgaattacttggtattatttatcatcctagtaagatctattttatataatttgattcactttttatattgaattatgttaattgtttttgtaatacacctttcatatttcttcaaagaaaactagtgttgggttattgctaattttgcttcgtggtttggttatttacatataaaaattatattgttttaaaaattgcaaagtgatcatttattgacacatcagcaagaattaatgttgaaatgcaagttttttcccctatccttaactaagtgtgtagatatctttgttttgtttctttaatagatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagtgagaatattctactttaacattatttgaatattttaagtaacattttcagcagaaaactacatattttatgatttctgttaaatttcccaaacatttcttctagttctttcttccatgtcatgtaatttattgtgtttttccatttatacaacctaatgctaggttagaaaactgatgcttaggaagatatggtattatcttttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggctaacatgactgctagtgctcaccttggccctttagttcctgtctaagcatggatagacatgagttagtataaaccctttaaaagtcacaaagctaaatctggttctacttgcttgggtccttatcggagctccactcctttgggtcacatgtcaaaaaaaaaaaaaaaaaggtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447381 - DNA, 4863 bp, Homo sapiens
aactacaaattcacatctcctgtgtgagccatgggtgagttgagtagaatggtggtagaattatatgggttacattaactacttagactttgtcctatttttcctatatgaaaatagttgaaattctcataaaaatgcatgtatgatgtgaaactgaagtataatgtacagtcagataattttgaatatattttgtgaaatagatgtttatgatttataacagcagtattttaatttctatgcagcttaaattgatgcttggataggggaaaaggatgaagaagaaactcaatggtatgttaactgagagaatgaagtaaagtggcatagtaacgacagttataaaaggggcactgcataccccattgctgtcaagggattgtaaacttccagactgggctaaacgaatgctgggaaaggtctgtacagccacaacaagtccttagacttaggacttagaagcttatttgcagtagttattttaggagttacaggattctggggactaattcatgttaactgaatttacaagacatatatatatttagttgagacatttaattaccaagataactagaaatctcatcagtaggaaggtctccttgggctgtttgttgctatgtttatgaagatggtttcatgaacatggagggagaagccgtaaaatggttttaactaatgaccaggcatgatagcttattcctttgggaagccaaggcgagaggatcccttgagccttgagcctaggaatttgagaccagcctgggcaacataataagaccccatctgtacaaaacattaaaagttacctgggcataacttttcctataatcctataattcctataatcccagctacttgggaggctgaggtgggaggattgcttgagcctgggaggtcgaggatgcagtgagcgatgatactaccactgcataacctgggcaatggagtgaggtcccataacttttcttttctttactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447382 - DNA, 4988 bp, Homo sapiens
acctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagaaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447383 - DNA, 4994 bp, Homo sapiens
acctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447384 - DNA, 3534 bp, Homo sapiens
gatctagcaggactccgtgatgttatcgcccaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447385 - DNA, 5828 bp, Homo sapiens
tcatttttgagattgagttaccatggagggaaagaacatgtgttttaccagtggaacgcattctttgtgttatctcttcgatttttaacattttatgtttccagtttataaactttgcctccagtttgatgaagaaaatttagctattagaaagtatttaaaatctcaaaagtatgacattttaaaatgttagcaggtttaaagataacttagtttttcaactcttaacccaaaattatacttgtatactataatttgtgttgaattacttggtattatttatcatcctagtaagatctattttatataatttgattcactttttatattgaattatgttaattgtttttgtaatacacctttcatatttcttcaaagaaaactagtgttgggttattgctaattttgcttcgtggtttggttatttacatataaaaattatattgttttaaaaattgcaaagtgatcatttattgacacatcagcaagaattaatgttgaaatgcaagttttttcccctatccttaactaagtgtgtagatatctttgttttgtttctttaatagatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagtgagaatattctactttaacattatttgaatattttaagtaacattttcagcagaaaactacatattttatgatttctgttaaatttcccaaacatttcttctagttctttcttccatgtcatgtaatttattgtgtttttccatttatacaacctaatgctaggttagaaaactgatgcttaggaagatatggtattatcttttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggctaacatgactgctagtgctcaccttggccctttagttcctgtctaagcatggatagacatgagttagtataaaccctttaaaagtcacaaagctaaatctggttctacttgcttgggtccttatcggagctccactcctttgggtcacatgtcaaaaaaaaaaaaaaaaaggtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcaatcctgcctcctgttcccattcctagtagctaaatccatttgcctcatttggttattttgcaatttatgcagaaaacgtcaccaagtaaataatctccaactttttcatactgtctttctcaactgacagtctcacagtcctt

SEQ ID NO: 447386 - DNA, 364 bp, Homo sapiens
tccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgt

SEQ ID NO: 447387 - DNA, 457 bp, Homo sapiens
cagggagagaacatctattttaaaaaataaccatctatctgtacctttctgtgcatttctcattctttaaaacagcactttgattttttaaaaaaatcctctgcacgtgtcaggggccaccatcagctatattgtgaaaataaaaaggcagctggaattaaatgatgggcctcactgtctgtttttgctataggtgggaactgcaagatacatggctccagaagtcctagaatccaggatgaatttggagaatgttgagtccttcaagcagaccgatgtctactccatggctctggtgctctgggaaatgacatctcgctgtaatgcagtgggaggtaggtgtggaccagcatcattgtgtagtggtaaacttgtcttcaaaataagatcatgtgttgcttcgagcattattccaggggttacaaagcagttattagagctagttgagatctgatat

SEQ ID NO: 447388 - DNA, 5048 bp, Homo sapiens
acctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447389 - DNA, 5123 bp, Homo sapiens
acctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447390 - DNA, 3868 bp, Homo sapiens
gtagatgtaaaatcagacatataggttcaaacaatcgattgcaaaggagcacttgtcaaaacactggctgggaatctgctcatgtgatgaagaccccagggtttagagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447391 - DNA, 3359 bp, Homo sapiens
ctgtatcactttgaatcccttttctctctgtcttcacatttgataatttatgtgatgtatctttaaattcactgactcttccttcatgttctttctactcatgaaccattctaatgagttttctatttcaaatattgtattttcagttctaaaatttccatttggttcattttatagtttctatttctctgctgagagcttacatctttttgtgcatttctagtgggctttctttaccttgtagttctaacagctgttttaaagtctttaataattccataatctgggctttcttgggttttgcatctgttgattgtcttttaccttgagagtattggttacattttctgattctttgtatagcaaacaattttggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagca

SEQ ID NO: 447392 - DNA, 1850 bp, Homo sapiens
acctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggccccttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagacactttgcaatacagag

SEQ ID NO: 447393 - DNA, 417 bp, Homo sapiens
aattcgcggccgcgtcgacacgacagaagggaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447394 - DNA, 405 bp, Homo sapiens
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgggaagtccctgtgggagctggtgctggaacagtttgaggacctcctggtgcgcatcctgctgctggctgcccttgtctcctttgtaagtagggccctgccagccatcctgtggtagtcggtagccctggagggagagccaggctgggca

SEQ ID NO: 447395 - DNA, 4606 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447396 - DNA, 4803 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctgtgagtcaccccgcctgccccactgccctggtccctggacatcacaggccctgggctggtcactggacctctctggcccccctgcaatggaaactacctggaggagagggagctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447397 - DNA, 3454 bp, Homo sapiens
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447398 - DNA, 4445 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447399 - DNA, 1612 bp, Homo sapiens
tctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447400 - DNA, 4097 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447401 - DNA, 1455 bp, Homo sapiens
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447402 - DNA, 332 bp, Homo sapiens
ctccaagcactggggccaagggtatggcagatgctgattgaccagccagggcccaccactggcatcgaggggaggtgcctgcaaaccacagggctgagagaggaaaagggtggctccctgcagggaattcagggaattattaggcaggggaaacagacgccagaaaaccaccgccattctctacagccggtctcctcccttccccgcatgtacgtaggcctggccacagtggctgccgccacctggtggtttgtgtatgacgccgagggacctcacatcaacttctaccagctggtgagcaagggctggccagggagcctgttgaacttaca

SEQ ID NO: 447403 - DNA, 4691 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447404 - DNA, 5118 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacggtgagtgggaggccccgtcccgcctccagcctgcctccccgcccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccgggttgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447405 - DNA, 4166 bp, Homo sapiens
  misc_feature (915)..(915): n is a, c, g, or t
ggccccccctcgaagatcaggcccttaggccggatccggcttgggacatcgtcccatggacattgagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447406 - DNA, 2913 bp, Homo sapiens
cttcccacttgcagattagcaagatgagagaaaagccccacctttaggcagtcgtgtgtgtgtccgtgtgcgaatgtgtatttgtgtgcacatggcctgagtgcctgagtgagaggtgtgtgtaatgtgtatattttgcatgtgtgctctggtgcattttgagcgtgagtacaagcagaaggatttgtgccggcgtgtgactgtgcacacactcgtattcacatgtgaggatgcctgtggggaatggtgagcgtgtgtgttgctggacatggatggattctgcatctctgcacctcagggcagatatgtaggtgtttgcttgtgtttgccggatggtgtggcatgtgctaggtttttgcacatgtctgattcttgggcatgccctcttcgtgtgcgtgtgtgtgtgtgtgtgtgtgtgtgtgtgtgtgtacttggcctctgctaggcctaaagagcaggtatgtccaggatccagagctgggactggggaaggcaggactggccaggcccgaggcagagctgtgtacacacacccttcacatcacagctggcggagggaggaggggctgctgtggagacagtgggtgggtgagctcccagccttgggtctgagcaggagctggagcctgcatctgccgggggctaggcctaccggggctagagctcatgactctgttccagcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447407 - DNA, 4189 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgga

SEQ ID NO: 447408 - DNA, 3004 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctggtgagcaagggctggccagggagcctgttgaacttacagctcgagttgttggagttccaggggagatgggtctagagccgcatgggtggcctgcagtgtccttccccactcgctatacacgaataaacatccccacctggggagccgagctcagagcccacgggaaacccagagacaccagcacggacccccaagccaaaggcgcctccccatcccagtcagttagcggggaccaagaggcctcactgccagatgt

SEQ ID NO: 447409 - DNA, 2505 bp, Homo sapiens
  misc_feature (1440)..(1440): n is a, c, g, or t
cgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtangagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctggtgaggccgggccttccctcctctcagccctctcaatccgctctgt

SEQ ID NO: 447410 - DNA, 2856 bp, Homo sapiens
gttgtgactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447411 - DNA, 162 bp, Homo sapiens
gcggccgcctactactactactgctcgaattcaagcttctaacgatgtacggggacatgaaagcagtttagcattgggaggaagctcagatctctagagctgtcttgtcgccgcccaggattgacctgtgtgtaagtcccaataaactcacctactcatcaa

SEQ ID NO: 447412 - DNA, 2858 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447413 - DNA, 2156 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447414 - DNA, 2898 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaaaaaaaaaaaaaaaaaaaaaaaaaaaaaaaaaaaaaaaaat

SEQ ID NO: 447415 - DNA, 2077 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447416 - DNA, 2828 bp, Homo sapiens
tgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447417 - DNA, 2023 bp, Homo sapiens
aaaactcaggcattgtttccaaaggaagagctaatgggcctatttgacttctgagtgaagcaaaaactacccagatccattccctataattcacatccccaaaggtcaaaaacaaactaggaggacctgggaatttcagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447418 - DNA, 726 bp, Homo sapiens
ttatttgtattgtgtgttgatcaccccccgggttttccccttcccaccgtggtaaaccaccgcccctgccacactttcaagccctcagggtggattttgagggatcccccaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447419 - DNA, 530 bp, Homo sapiens
acttacgcacaggtcaatcctgggcggcgacaagacatctctagagatctgagcttcctcccaatgctaaactgctttcatgctaattttctgactgtttacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaccactgctcgtgcaaggacaggttctcgctatattgcccaggccagtcttgaacacctgacttcaagcaatcctcttgcctctgcctccccacgtgctgcagttacaggcgcgagccaccatgccagcctgaatgttcgttgttgttgttgtttgagatggagtctcacccaggctggagtgcagtggcgcgatctcagctcactgcaacctctgcctcccgggttcaagcaattatcctgcccagccccccgagtagctgggattacagcgcccaccagcactcc

SEQ ID NO: 447420 - DNA, 3010 bp, Homo sapiens
  misc_feature (236)..(236): n is a, c, g, or t
gttgtgactttccctttcgaattcctcggtatatcttggggactggaggacctgtctggttattatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgnagaatggtgcctgtggcatgatgccagctttgcaatcatgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447421 - DNA, 2920 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaaaaaaaaaaaggggggggctaaaatacccgaagggccagttacgctacagtttctgtcaaggc

SEQ ID NO: 447422 - DNA, 3099 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaccactgctcgtgcaaggacaggttctcgctatattgcccaggccagtcttgaacacctgacttcaagcaatcctcttgcctctgcctccccacgtgctgcagttacaggcgcgagccaccatgccagcctgaatgttcgttgttgttgttgtttgagatggagtctcacccaggctggagtgcagtggcgcgatctcagctcactgcaacctctgcctcccgggttcaagcaattatcctgcccagccccccgagtagctgggattacagcgcccaccagcactcc

SEQ ID NO: 447423 - DNA, 2897 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccggctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctagcacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447424 - DNA, 1208 bp, Homo sapiens
gacatactgtgctaggtgcgaggctgctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaacgagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 447425 - DNA, 3384 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447426 - DNA, 3562 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagaccttcagaaaatataaatatgaaataattaaggaaaaaaaaaaacaataaaattggggggggggcccggtaccccaattcgcccttatag

SEQ ID NO: 447427 - DNA, 3296 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447428 - DNA, 3342 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447429 - DNA, 3283 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtgcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447430 - DNA, 3222 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaactatttaatttattgtaactatacttggagtcaaaaaccaacatcaggagacagtgatgtagattaattccaaattaaattggtagtcaaaaaaacttaggaggaattcagtaaaaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgt

SEQ ID NO: 447431 - DNA, 1349 bp, Homo sapiens
atcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaattaagggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447432 - DNA, 1425 bp, Homo sapiens
atcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaattaagggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtaggaaatattgaataactagaacacaagccactgtttcagctccagaaaaaagaaagggctttaacgttttttccagtaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447433 - DNA, 3616 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagaccttcagaaaatataaatatgaaataattaaggaaaaaaaaaaacaataaaattggggggggggcccggtaccccaattcgcccttatag

SEQ ID NO: 447434 - DNA, 3342 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattgtgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447435 - DNA, 3275 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447436 - DNA, 3245 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcaggagttcaccgaacagcagaaagaatttcaagctactgctcgtaaatttgccagagaggaaatcatcccagtggctgcagaatatgataaaactggtgaaaaacattttgatactgtaggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctaccaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatca

SEQ ID NO: 447437 - DNA, 2003 bp, Homo sapiens
  misc_feature (264)..(265): n is a, c, g, or t
  misc_feature (862)..(862): n is a, c, g, or t
ctgcaggacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttnnttaccaccaccactttgaaggctttcttgcctataccaggacaaactcagctctttatcccttttccgaattttcctggtactttcactttgaatatagcgcttaattaacattctgccttgtacctaggactaacacactataaattcccagaagacaaagtaggggaatacaataacaggatatagaattttaacagctaaattagatgaatttatgggtgacctttattgggcaaaagaaaatgttaagttagtataagatttagtataagctaccactcaaaactcagggtctcactggaagagaaagtgactccaggtagaattcctcagggagacattcacttccatcattcgctgaaccaggagctttggacagcctcggattgcacccgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccnttctctccgggtaaaggtgaaggctgaccacggggccgctctccctccagccccagccacgccctctaacccaggttcccgtcctgcaccgcgccgcaagtccccccaccgttcagcgcaaccggccctcccagccccgccgccgtccccctccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggtaagctttctttatatttttaatactggaatgcatatgagtaagaaaaattgtggaactctactcagtcatttttttcaaatatttcttgccattaaatgactttctacctttgtcttcctgctcagactacagtgtttgcccacttttggaagcttgcactctatacctagatgcgtttttccttcttctaactggttccaaccttaacttgcacctaaaccttggtaacttccgtttctagagttggtcaatttgttgtgttttattcctatcttctatattacattttattgagtcttttttgtgaactcatgattcttttcctcagac

SEQ ID NO: 447438 - DNA, 1087 bp, Homo sapiens
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447439 - DNA, 1146 bp, Homo sapiens
  misc_feature (1099)..(1099): n is a, c, g, or t
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggcacaaaaaacacnaccaaacaaaaaaacacagggacacactataagagaggaggaaaagg

SEQ ID NO: 447440 - DNA, 510 bp, Homo sapiens
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagaactgctcagggtagactggagacaaaagcaacagctcagaagtgctaaatcttgaagagcagccaaagcatgggcaacaaagtgagaccccatctctacaaaaaaaa

SEQ ID NO: 447441 - DNA, 481 bp, Homo sapiens
tgaacttgctctgctgttatggcacctgaaaactagatgttcttggatgggggtcttccttcatcaaagcttcttcccatttgtacttcagttctaggacaaggcaagaagaaagcaagaagctgtaaatcccattcctctgggtctcaatttcaccctcagttcaaggagctgagtaggcagaggcaaaggctatactcaacacacgtgcaattgaaagcaggcgaggcaaaaccagggcagaggaaaggaaaggggtgtgtgtgtaggtatggatttatgggtaggtgggtcggtaggttagttgaagaggaggttctaagcagtataacctaagcctcttttctctttcttctgcttcaaacaccttaagaactgctcagggtagactggagacaaaagcaacagctcagaagtgctaaatcttgaagagcagccaaagcatgggcaacaaagtgagaccccatctctacaaaaaaaa

SEQ ID NO: 447442 - DNA, 801 bp, Homo sapiens
  misc_feature (52)..(52): n is a, c, g, or t
  misc_feature (60)..(60): n is a, c, g, or t
  misc_feature (66)..(66): n is a, c, g, or t
  misc_feature (69)..(69): n is a, c, g, or t
  misc_feature (72)..(72): n is a, c, g, or t
  misc_feature (75)..(75): n is a, c, g, or t
aaggagagtttgtatcataagtaggtgttggattatgtcatatgcgtatgtnctgcatcnggtgantgntcnccnatccccggattggcgaccatttcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447443 - DNA, 920 bp, Homo sapiens
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatgggggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447444 - DNA, 755 bp, Homo sapiens
ctgcgattgctgttttcctgagggggctggtggtccttggctatacgttgatcatctatagtagatctaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447445 - DNA, 839 bp, Homo sapiens
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccgaagcagttgccgcatccgaagcagttgccgcatccgaagcagttgccgtatccgaagcagttgccgcatccgaagcagttgccgcatccgaagcagttgccg

SEQ ID NO: 447446 - DNA, 361 bp, Homo sapiens
aaggctgaagcatcactggctgtgacaaacctgagcccaaactgttcactgctctcactgttcttccctaagttttctgtctggccttttctagagcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggtaggcagattgcttgagctcaggagttcaagattagcctgagcaacatggtgaaac

SEQ ID NO: 447447 - DNA, 1297 bp, Homo sapiens
ccttgttcaaacagcacttacaggtggggacctgtttttgctaagtcatcctggggatgctcaaagctccattgttagatcctttctgtcctccttcctggctcctccttcctccccacccctctaataggctcataagtgggctcaggcctctctgcggggctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcagagcaggagagacagaagtagcaaaccctctttcgagatgtccctccagccccagaagtacctccagcctcacaccatctcttcagcctagcaagttgctggagggagtctataacctaccaggagccagccagccatttgtatcaagaaatagaaatctgccagggtacagtggctcacacctataatcccagcgctttgggaggctaaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447448 - DNA, 922 bp, Homo sapiens
gcatggtggcctgtgtctgtagtctcagctactaaagaggctgaagcaggaggaatgcttgagcccagaagttcaaggctgcagtgagcaacacctcgtctgtcttgtctctctctctttcacagtgaaaaagaatgaccctggggagggagtgtaggagggtgaaagagtttcatgttgtggatctttctcttcccccacccactgtccacgcactttgtctttttcctcccctaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaacggc

SEQ ID NO: 447449 - DNA, 787 bp, Homo sapiens
  misc_feature (23)..(23): n is a, c, g, or t
  misc_feature (690)..(690): n is a, c, g, or t
  misc_feature (703)..(704): n is a, c, g, or t
  misc_feature (712)..(712): n is a, c, g, or t
  misc_feature (719)..(719): n is a, c, g, or t
gggtagtagcgaggctgggtgtnaatcggccgaggggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagcccgtgatgtgaccanttcacgggtggtnnggctatgntcccggntagagccctgcccgtgtgggtccgtgggtttggcccgtggggggtggttcggcgggggggggactggg

SEQ ID NO: 447450 - DNA, 4491 bp, Homo sapiens
cgtcagccccagtcaggcgtcgtgcgaacagcagctggtaccgaaggcggaggtggagcccgagagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447451 - DNA, 4589 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagccctacgactgcccctgcagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447452 - DNA, 4566 bp, Homo sapiens
tgactctagtaggatccccagtcactgatgagcctccttggaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447453 - DNA, 4251 bp, Homo sapiens
agagtaggggatgaggggttgggatttcctctgtgagatgtcatcttcctgccccagggccaaaccctggccctcttagctgcacgctcctattttctccaggcccctgccctccacctgcccttgctcacgccctctgcccattatttttcagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447454 - DNA, 3419 bp, Homo sapiens
gactctcccttctaatcttctctcccccatcaaattccaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447455 - DNA, 2804 bp, Homo sapiens
aaaggctaggtacgaggctgggtgttgaattcgccgaggtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447456 - DNA, 2417 bp, Homo sapiens
ccgtgggggaccagtgacattctccccaatccccaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447457 - DNA, 2558 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtgagtgcccgcaggggac

SEQ ID NO: 447458 - DNA, 3110 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447459 - DNA, 1505 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtgcgtgtccttggggactggctgggctgggtccccagggccggtgtgtagaatgtgccttttgcaggttcctccccaggggtggccccgccacaggtttagcctgtgaattggttagcttggcagtatagcctcaggcaagtcacttcacatccctgtgcctcagtttcttctgctataaagattgatgaggctgggcgcagcgggagggagcactttggaaggctaaggcaggaggcttgcttgaggcaaggagttcgagaccagcctgggcaacataatgagatcccatcttttaaaataataataataata

SEQ ID NO: 447460 - DNA, 1324 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcagccctggaagcgcctttctcgaaagcgggtaaaaccttcctggccaaagtctaggcccctgggcaccagtcgcacattcctctgttttagagcatagtctaccacccagctcagttactccatctcacgtttgat

SEQ ID NO: 447461 - DNA, 1828 bp, Homo sapiens
aggtgggagagaccctcacgggctgaatggccaggcctcagagctaggggcttgttggtgagggaggtgaccaagatgaggtccagagctctggtggggcctgcagaccatggggcggtccctgagaccaggtccaggaagaggagcaggtgtggggaagacgctgaggccagtttgggacatgaagagtcaagaagcagtctcctttttgcctgttagcttcattctgatgcttcccttgctgattgggtcaccctgtccaccctgacatgcaccacaggccccaggccttggaaccaggcccagccttggcctttcctgcccccatttcaccttgagttctcagaatgagccctgagcctgtgtcccctggagtatgggcctcagtcccatgttgggagcaggacaggctgaccaggctgtccccatcctccaggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447462 - DNA, 942 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacggtaagtcgggtagacaggcggcttggtggggagacatggcaacacccagagggaagaacattgtcaacttcaggggtaccaggtgcctctgttgtgagcagagctgcctgctgagtgagctgcttgagctggaataagaccactgcctagatggaagggctcttc

SEQ ID NO: 447463 - DNA, 502 bp, Homo sapiens
ccggaaatctcgtgttaaggcgaaggtcaacgggtatggttctcgcgagaggacccgtcagccccagtcaggcgtcgtgcgaacagcagctggtaccgaaggcggaggtggagcccgagaggtaagtgcgtgtgcagaggtggcagttccgggcgccggggaggtgtagagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtctgtggctggggcgctgggggagacattgcgtctggggacaggactccggg

SEQ ID NO: 447464 - DNA, 356 bp, Homo sapiens
attcccctaggacccactcagcccactcagctgggctgttgcactgacctcggtccatttccttctcttcccctcaccgctgggggcttagatcacggagggtgtgaagccaacactctctgagctggaaaagtttgaggaccagccagagggcattgacctggaggtggtgactgagagcacaggtatttgatccccctctataacctgggccaaggagcaggggcggcccatggtggcaacccccgagtcagccctacgactgcccctgcagggaaggagcgggagcacaacttccaacctggggacaacgtggaggtctgtgagggtgagctcatcaacctgcagggcaagat

SEQ ID NO: 447465 - DNA, 437 bp, Homo sapiens
tgtgacccggaagaaggacaaccgctttgctgtggccttggactcagagcagaacaacatccatgtgaaagacatcgttaaggtcattgatggcccccactcagtgagtacaagttcctgcttttgagctgcatctgaaagaatttggttggttgggggtgagggggacatggtcaagagagtgacccttctctccccggctagggccgagaaggggagattcgccatctcttccgaagcttcgccttcctacattgcaagaaactggtggagaacgggggcatgtttgtctgcaagacccgccacctggtgctggctgggggctcaaaggtgaggtgggcatggcaggaccctgtgcgttgggtacctggctcagctctccaagcctcctctggccccagaagtgataagattgggcttgtgagggattaggagag

SEQ ID NO: 447466 - DNA, 788 bp, Homo sapiens
  misc_feature (758)..(758): n is a, c, g, or t
  misc_feature (784)..(784): n is a, c, g, or t
  misc_feature (786)..(786): n is a, c, g, or t
tgactctagtaggatccccagtcactgatgagcctccttggaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaagggatcccaatctgtggactggtcaaattgttaagaattgggggaaggaaccgggcccacgggccattttcccttggaatgccnccaaggtttcaattggccttacccangntt

SEQ ID NO: 447467 - DNA, 4569 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447468 - DNA, 4623 bp, Homo sapiens
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447469 - DNA, 4622 bp, Homo sapiens
tccagactgccttcagactcccaagaaacctcgccatggaggcttcattctggacgaggctgatgttgacgatgagtataaggacgaggaccagtgggaggatggagcagaggacattctagagaaagaagagattgaggcctccaatatcgataatgttgtcctggatgaagatcgttctggggctcgccgcctgcaaaacctctggagggaccagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447470 - DNA, 3482 bp, Homo sapiens
ctgtgtgcccccagaacccccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447471 - DNA, 3702 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggtacgtggggcccagggtggtgggtgagcaggcatcctctccttggtaccccctaaactggagacagacctgtccccagatggtgacagcccagagtgggcagagctgggattgaggaagcctagagggcaaggggagctatgtgaacccaaaggaggcatcttacctgatttagcggggaatcagggagggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcactctgggaggccgaggtgggcagatcacctgaggtcaggagttcaagaccagcctggtcaacgtggtgaaaccctgtctctactaaaaatacaaaaaaaaaaaaaaaaaa

SEQ ID NO: 447472 - DNA, 2703 bp, Homo sapiens
  misc_feature (2703)..(2703): n is a, c, g, or t
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgacacagcggttttgtggtttcgccagacctggtacgagccgaattcgaataatgaaan

SEQ ID NO: 447473 - DNA, 2776 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacggcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447474 - DNA, 1902 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagccctacgactgcccctgcagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgacatgtacgggaaggtgtgactgtctcacatatataagacccctca

SEQ ID NO: 447475 - DNA, 1610 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttggtactcaggggaatctgtggcctgggggggagggagtgtgctcgatcccactggtggccaagccccctccctcacccttcccacccatgcccctttcctccatagaaagactggtttgccaaaaggaagaagtttaagcggcctccacagaggctgtttgatgctgagaagatcaggtgcgtgtccttggggactggctgggctgggtccccagggccggtgtgtagaatgtgccttttgcaggttcctccccaggggtggccccgccacaggtttagcctgtgaattggttagcttggcagtatagcctcaggcaagtcacttcacatccctgtgcctcagtttcttctgctataaagattgatgaggctgggcgcagcgggagggagcactttggaaggctaaggcaggaggcttgcttgaggcaaggagttcgagaccagcctgggcaacataatgagatcccatcttttaaaataataataataata

SEQ ID NO: 447476 - DNA, 900 bp, Homo sapiens
cgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggagggatgacgcattctggaggtggacggtggtaatggatacgcatgatgctgttgtctgctgcag

SEQ ID NO: 447477 - DNA, 1263 bp, Homo sapiens
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaatttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaaacagaaaaaaaaaaaaagaagggggggctcaccagaactatatcctccttggggggcccctcacgcgagcaggaactactatgtgagtcgtcagggcccgccccctgcgaagggggggagaccacataggcaacgaggcagcggaggaacgaggggacactcacattgccgactgggaacgaccggagttgaatgcccgcatcggcgttggagagacacttccacagccagtgtgagtcgggccaatagaatgggagaggaggcgggacctaccaatgagctggcatgacctgacgacgggtgggatagtgacaatgaaacaaagggcgattgagaggatagcatggaggaaagcgctaacacacatgaacgtgggcggaacaatcccaaaaagggaacactactgagggacgccaccgcggggggggcaccccaaagtcgcaaggaacaaccaatcggcaacagagctggcaaaccacgaccacctcacaggccttggcaacaagaacaggtggggggggcagggacaacccctatctaggaagcgcgggagaaattaccgaaacaggggggggaacgtcgggggggtcgagggaccacggggggacccagcagagagggcgatgccggccacgggagacactagtatgaccactgcgggagcgctgaccaaacaaccggcgtcggaccaccccgacacgcggctgaaccagttactcggccacacgggagtagcccccaccaagccgtgagcaacgaaaccacgggcactgagagctccgccgcggaacggaaaaacccaagcgaccagcagagcaaaaacacgcccgctgaagaggcgcagtccgccacaagagagag

SEQ ID NO: 447478 - DNA, 2184 bp, Homo sapiens
ggcacgaggcggcggcgggcgcggcctcctgggcgcggggcggctgcgaggagcaggaaagtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447479 - DNA, 717 bp, Homo sapiens
gatactctagacgcccctccgatctagcatactcaactagataccttatttcaaaactacatgtaacctattttgctatagatactctaaacaaatagttacatgtagtttgaaataaggtatcctattttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447480 - DNA, 475 bp, Homo sapiens
attcccagtgggtcttctcactcttttccaggctccttggaggtcactgccctgatgacaacatggtcttcccttcaaggaagccacgtttctaagagggctctggcatatgcattggcaaccagtgacctggaaatgatatctgtaaatttctggctacaaaaaggtgttctttactttcaaatctcctgatggatgctgccataggaagcacaagagggctgaaaccaatacaggagtctgtgctaatccctcaggactcaaaaatgccccaatttttggaggacaagggtcatcttgcccaccttgcaaccagccagccattccaggaaagctattcctgcagcctcatggtagggtgagggctgagaaatggggcatggcagctgttttgcatccaccctgttgctgttctcttaccaacaaccagcagcctcttttttcatcaagaactcccctggctgtttattcatgt

SEQ ID NO: 447481 - DNA, 3004 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447482 - DNA, 3538 bp, Homo sapiens
gggtgctttgcttatattctgttatatatttattataaatatattatactaatatgagatacacaataacttatatatgaactaggtttatgatgagctaagtttgtgatgaagttgcacaaaattgtggcttagaagcaatataatgttgtctctctaacataaatgtcagaacgttaatagtccagggctggacagcaactgtgacccataaagacctctcaagttccattctctcacttcttgcattatactggactttcatttctaagatcactttatgggctaagacaattcctccaaattgagtcttcataaacatactctatgcaacagaaaggagaagagacaaagaaagcagggttaaaggcttatgctagctattgtatgagaaagattcacacagtaatcacgtttgtataccaatgtttgatggtttgtcactcagtcatgtcttagctgtcaatgaggctaggaaatgtagattttactttggggagtaatgttccctgtgtgtatttggtgttttctgtcaacaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttcaaagactt

SEQ ID NO: 447483 - DNA, 2923 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447484 - DNA, 2241 bp, Homo sapiens
attcccagtgggtcttctcactcttttccaggctccttggaggtcactgccctgatgacaacatggtcttcccttcaaggaagccacgtttctaagagggctctggcatatgcattggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447485 - DNA, 1795 bp, Homo sapiens
gactagttctagatcgcgagcggcgctcgcgatctagaactaggaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447486 - DNA, 3046 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgagttgaacatatagttgaccagattaaatgcagcaaacatccaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447487 - DNA, 2952 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtgagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447488 - DNA, 1527 bp, Homo sapiens
tctccctactgtatcctaattgtggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatacagtagggagatctccctactgtatcctacctacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447489 - DNA, 1122 bp, Homo sapiens
cacttactgctcctaacggcaaggagctgcgaccatcaggacgcgcagacatttacagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447490 - DNA, 1595 bp, Homo sapiens
ctatttttgtataaaacgacatgtacagatatttccagcaatttatgcacattctttaattctgttccagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagaccttttatttatccatttcttttttttcccagataaaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447491 - DNA, 2355 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447492 - DNA, 2332 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggtgtgtgtgtgtatcttttaattctttatttcatatagtatctttgaccagttttagctatttaatctgaaaagtcataagattaaattaattctaggttttatactttcttggtactaattaataaaaaattaatagtcacaaaca

SEQ ID NO: 447493 - DNA, 452 bp, Homo sapiens
gccactctgcccaggagctgccgaccatcaggacgcctgcagacatttacaggtgggaggcgctcacagctgcagggcagtctgctgggcttgcctctctttctgccactgaacctttactggagaaagttgactgtaacacagaagaccctcactgaaaagtgaagtgttctgaggagttaacttaggatctgataggctgaccggctgtagcttcccagtccagagcagtgggaatggaggattttttttttttttcactttctcctcttcaccagtgcttttgaaacatttccaaatggtctagtcagaaaatcttgtatcttcagaaagcatttttgtttccagtgggctaggtccctacgtttctaccacagccgtaacatgcttggcatgcagtttaccttttcagagtagaaattatactgttgcaggttttttttttttttcct

SEQ ID NO: 447494 - DNA, 2628 bp, Homo sapiens
gggtgctttgcttatattctgttatatatttattataaatatattatactaatatgagatacacaataacttatatatgaactaggtttatgatgagctaagtttgtgatgaagttgcacaaaattgtggcttagaagcaatataatgttgtctctctaacataaatgtcagaacgttaatagtccagggctggacagcaactgtgacccataaagacctctcaagttccattctctcacttcttgcattatactggactttcatttctaagatcactttatgggctaagacaattcctccaaattgagtcttcataaacatactctatgcaacagaaaggagaagagacaaagaaagcagggttaaaggcttatgctagctattgtatgagaaagattcacacagtaatcacgtttgtataccaatgtttgatggtttgtcactcagtcatgtcttagctgtcaatgaggctaggaaatgtagattttactttggggagtaatgttccctgtgtgtatttggtgttttctgtcaacaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447495 - DNA, 2821 bp, Homo sapiens
gggtgctttgcttatattctgttatatatttattataaatatattatactaatatgagatacacaataacttatatatgaactaggtttatgatgagctaagtttgtgatgaagttgcacaaaattgtggcttagaagcaatataatgttgtctctctaacataaatgtcagaacgttaatagtccagggctggacagcaactgtgacccataaagacctctcaagttccattctctcacttcttgcattatactggactttcatttctaagatcactttatgggctaagacaattcctccaaattgagtcttcataaacatactctatgcaacagaaaggagaagagacaaagaaagcagggttaaaggcttatgctagctattgtatgagaaagattcacacagtaatcacgtttgtataccaatgtttgatggtttgtcactcagtcatgtcttagctgtcaatgaggctaggaaatgtagattttactttggggagtaatgttccctgtgtgtatttggtgttttctgtcaacaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcggtttgaattatccattaactagtggggatgcaagctcgcccccttgtcattaaaatacatattcataaaactttaaagttgcagtcg

SEQ ID NO: 447496 - DNA, 2943 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447497 - DNA, 3710 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgagttgaacatatagttgaccagattaaatgcagcaaacatccaggtgaaattgagtcatttctttttttgtggaacttctgatttctgtcattgagttaattatattaaaattttgaaacctgtacttattcctactagtatcagcacttttatttttcaacttccactgatcttttaaaattgaggcaatatgcagtaaaatatttaaataattgcataaacaccaccaaagagatatcagttagaaatgtcagtactggtgaaactaagctattggctagcaggcagcaaggccatcataggatagctcattcatcaactgatgtacaaaagtcagagtttgacaccctaatagcatttttattttaatacattatttttcacagcatgggctggacatgaatggaatgtatgaaagtttgaagaccttttatttatccatttcttttttttcccagataaaatttacattttacattttgttttcttgcatgtatactgtaaaaattacttctgtttggtggtgaaattaaaacttaatggtgttggtttctctgaacaattagtattttggtgtagtagtgttgtctagccaaaaatctcgtgaatttacttttaatgaaaagaattgccaaatgagtgaatgggaagattttgtgggtgtcttatttgcattttattaccataacctgacttttgttttctaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447498 - DNA, 2950 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447499 - DNA, 1826 bp, Homo sapiens
  misc_feature (239)..(239): n is a, c, g, or t
cctggcaataaattacctgtgactctcgaacttcatagacaaaagcaccgtgagtagctcataaagcgcgcgattccgaaatcaggaaaacttcagagttatttttgaaagcagcatattgcaaatgattgtgaagatccaatcgaattcgtctatactgatccccacctggagggctcgatgttgaagcaacatatcagtacacatggcaacgaattgctagggatgatctctgcatntttaaagccttgcatgactcgctggattcgcaattcgcgagcatccatcctcattatctctctcgaaacgacgtacaagagaaccatcgtatccacaacatcgtggactgcgatgccctcgcactaactgagactcatcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctca

SEQ ID NO: 447500 - DNA, 3265 bp, Homo sapiens
cagtaattaatgaacatgcaaaatataattgtatatttcaactcactaaaaaggcacagaaagagttgaatttgctaaaattaaatgtgcttatgaaacagctctagtacatgaattaagctcctagatacagatgcagcgccaaacgacggggagggagatggggcactcaaggcgacacgcggctcttgttgccgagcgtttcctgggcgtggagcttctatagaatgtaagctttttttttttaaggttccaaagcctatatttagtgctttcatatacgtaatctcaaaaaaaaaaaaagaaagaaatatcggcataaaatgtaagcttccagagggatacaaacgcagcccagcgcggacaccgccagccccagccacgcggttcgcatcaagcgcactcccctgggggcggggcctgcgcgagctgggcgtgtcgggggcggggcctgcgcgcttgcttccggcgtgccgcgagaggcggggcgtgtggggaggcgcggccgccacgcgacgcctggctgggcccgcaccggagaggcgtctcggtacctggcaggcggcctgctactcggagcccgctgcggggcggcggcggcggggacatgcacgtgtgagatgcggcagcgggcggcgcggacgcgaacagcagcggcggcggcgggcgcggcctcctgggcgcggggcgcgcggtgcctgagggcgggcgcgcgggcgctgggcaactgccggccgcgccgcctgcgcaggcgctggttcaggactcacacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctcaaaaatgttgtgaactttatgattcaaaattgagtacagatatgtccttgattcatatgtatgctacatgtatcacacaacagatctggaattctttcagttcctcagatacttctcccttagtttttgcagtttcactgggattatgttttgggaaacaaggaaaggtctagatgcttaaacattttaaataaaaattccttacagtttcatcttcccaacattttcattctttaaggctactttcctactaactgaaataacacatttacttttaccacaattcctcaaaataaatttattctaacattgaaaataacattacaagttaatcattagcttgatgcatgctaaaatgtagcttttaaaaagcattctgcattagtactaaaataagccatcaatgccagtccaccctctctattcatggctaaatatttaaaggttatttatagcttctttaatgaattcttcttaaacaaagtgaaattatgtcctagaaaagtagaagctattcgtaactagagcagtgcaactttaaagttttatgaatatgtattttaatgacaagggggcgagcttgcatccccactagttaatggataattcaaaccgaggactgattttgaaagatcacctaaaaatgtagatttgttctttagtaaatttagatcaactatgcatatattttgtaggtaaatctttcagtccatgccccaaccctcaccaaaaccaaagcagaaattacacacacaaagatgctcccgttaggaattgctattcacatgaggctttctgtgctagatttttttctcagaaacaaactttactgtaggactattgtggtgttcttaacagatttgtaatttcaagatgcgtgtcattaaataatttttcatgttcaaagactt

SEQ ID NO: 447501 - DNA, 548 bp, Homo sapiens
cttctacgaccctttacctgaacttttcaactccgttggtggtgggaggcagcgggcagaaatttactgttggccactgccaggtctatttcatatttcaaaggaggtcccggttaacccgggaccccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgttggaccctgggagccattgaaagactaactcacgcaaggctgtggtctgatctaatttgcctttataaatgcctacttcatgcagtagataaagc

SEQ ID NO: 447502 - DNA, 405 bp, Homo sapiens
aacacatgtctaatgtgctatgctcgggctcaaatgacgcaaaccccgaattctggattcacatagcacaggctagttgtccttttgatccatactccttgtctggtcgattcacggcaacgtagcatatagcatgtgctgtgataatcatcacagtatcatgagccatcctcaatagactgcctggcaaggcacgcactgctatcagcgctgagtctttgcttctataatagtcctgacttggaaaccctttcgggacagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctca

SEQ ID NO: 447503 - DNA, 2959 bp, Homo sapiens
  misc_feature (6)..(6): n is a, c, g, or t
  misc_feature (10)..(10): n is a, c, g, or t
  misc_feature (18)..(18): n is a, c, g, or t
  misc_feature (91)..(91): n is a, c, g, or t
  misc_feature (2955)..(2959): n is a, c, g, or t
ttcctncggncattgcgnagatttcatctggccaggacactggctgtccacctggcactggtcccgacagaggccgagctggggaaagttnatgttcactgggggcaggaaccctccttatctccaggctgcctcccaacctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447504 - DNA, 5258 bp, Homo sapiens
  misc_feature (4666)..(4666): n is a, c, g, or t
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaagggaaacaaaaacaacagcactcagtggcaggaaacacaactaggaaccatcacgcaagacacaaagttaaaccctggaaggtaacccaggtggcgcagcacactccgagctgcacggggacaaaacaccccagaaagacaatgtgacgcagcagctaggctagagacaaataatcacgggcacacgaatccgaggaatgggaaccaaccggagggcgaaacgaaacaccactacagagacaccccctaacaagaaaagatccagactgcccacagaaaagcaaacacatatcacctaagcggcacacacagtcccccggcggaacttcaccacggaaagacaaggccaganattactcaacaaccaccatcgaatacggggaccacggataacaatcacagcggcttgggaacacctgagccagcaccagaactcgtagcaacacactcagaagcaattccggtaccaacaagaattccacaagcaaacaccatctacgggagccacaccagtcgtacatgaggcacacacagacaaaacccacacaggctaccggcaagacaaccacacgttcgaaaacaccggcgcaataactaaacccggaacaggagaggagggacaacaacacacaccccccatgatagaatggcgcaccactgtgataaccaactatgcgagactggcacagaccacacccagtggggaccccacgcaaatggagaaaccacaagatataacgccacacgaaagaggatacaaacgtgcccacgtaacagggcattcgtgcgaaaaaacaaccggggccacaaacaagcagacacaagaaaacaacaaaacacacgcaaagttgaactacttcaacacgcgagtagcaacgcggctcaacaacaaaacaaacgcgggcacgcaaagaagacaccgctaggagcccaagctatcaacc

SEQ ID NO: 447505 - DNA, 2046 bp, Homo sapiens
  misc_feature (2042)..(2046): n is a, c, g, or t
agcggggaacaatcacttgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447506 - DNA, 2021 bp, Homo sapiens
  misc_feature (2017)..(2021): n is a, c, g, or t
gagaagattagcatggcccctgcgcaaggatgacacgcaaattcgtgaagcgttccatatttttactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447507 - DNA, 4238 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagtatcccgtcggtaccgagctcgattta

SEQ ID NO: 447508 - DNA, 5018 bp, Homo sapiens
  misc_feature (5014)..(5018): n is a, c, g, or t
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447509 - DNA, 4774 bp, Homo sapiens
  misc_feature (4770)..(4774): n is a, c, g, or t
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447510 - DNA, 1322 bp, Homo sapiens
  misc_feature (3)..(3): n is a, c, g, or t
  misc_feature (24)..(24): n is a, c, g, or t
  misc_feature (1318)..(1322): n is a, c, g, or t
ggncgactctagagtatcccctgnggagaagtgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447511 - DNA, 1288 bp, Homo sapiens
  misc_feature (1284)..(1288): n is a, c, g, or t
tccaaattccaggactccacttacgactattatgaggcaaacatctgcctgtgcacgttgtctttccatccagtctattctttggggtccagatccttgatcattctcacacccagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447512 - DNA, 3691 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccctgcacttgatggaccagctggcaccacccagatcaataaactggcttatttgaatttgcggccccccacccaggaactgactcagtgcaagaagacagcttcgactccctgtgatttcatctctgaccaatccgcactcctggctcactggcttccccaacccatgaagttttccttaaaaactctgctcccgaaatgctcagggagactgatttgataacaataaaactctggtctcccgc

SEQ ID NO: 447513 - DNA, 3420 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagcgttcttggctctggtatcaaccttctggcttctgtaatcacctcggaccggccgac

SEQ ID NO: 447514 - DNA, 2956 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagggcccggcgcgctgcagcacgtcccggagcctggcctccgacagctccacgtggccgcgcaggtccttcaggaacatgcggtcca

SEQ ID NO: 447515 - DNA, 467 bp, Homo sapiens
atgttgatggctggaaggctgtccaacgaaatgggtctcctgcaaagctccaatggtcacagcgccatcaagatgtgtttagctcagcccaacgactagaccctgtctattttgtggctcctggtatgtgaggaataatgtctcctatagaggccagcttataggactaggaagtcaagatagagaaattgagttagaaattgtggaaaccatataactttgggttcagggtagcagcatctccgggtagtgcaaccccagaagagagatgggggctaagcctgatttgagagtcactaaggaatggcccaacagagcagaatgtggtgtcccagaggtcagaccctggttgagctacctcctttaatcaaatgggaagtttctacgtttaccaccaaggcaagaaaccaaggactgtggccaaacctatgggtctattgagaagtaggtggaaagcaaaaacaaag

SEQ ID NO: 447516 - DNA, 5208 bp, Homo sapiens
  misc_feature (5204)..(5208): n is a, c, g, or t
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447517 - DNA, 4859 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttaca

SEQ ID NO: 447518 - DNA, 4953 bp, Homo sapiens
  misc_feature (4949)..(4953): n is a, c, g, or t
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447519 - DNA, 2004 bp, Homo sapiens
  misc_feature (2000)..(2004): n is a, c, g, or t
ctcatctcactcttcagagaggccagtcccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447520 - DNA, 1888 bp, Homo sapiens
  misc_feature (1884)..(1888): n is a, c, g, or t
cggtcaatttgtctacacacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgccnnnnn

SEQ ID NO: 447521 - DNA, 4460 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttgctttgctggtaggaaatgctttaatagtcgacg

SEQ ID NO: 447522 - DNA, 4180 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctca

SEQ ID NO: 447523 - DNA, 3547 bp, Homo sapiens
gaccacctgatcgaaggaaaaggaaggcacagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggagcagcctctcagtgtagatgaagaggggctggtcttagctgaaacagacaactagcgctctgtccaagccacaacttcagacctgtccccaatgtcaagcc

SEQ ID NO: 447524 - DNA, 2002 bp, Homo sapiens
cttggatctagagcgtggtgcgtgaagggtaacccgtggacaagctggatgacgagagagcttgcgctagcgtgttctcttgctcacttcaccgttggggacccgagtatacttagtaggtactgccgtcactgatacaactcggaacgcagacctctagtaatcatcgctaccacaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447525 - DNA, 1401 bp, Homo sapiens
tactactactaaattcgcggccgcgtcgactttttttttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447526 - DNA, 567 bp, Homo sapiens
ctaggctgggcaacatagtgggagcccatctctacaaaaaataaaaataaaaaattagctagatgtggtggcatgcccctgtagcctcagctactcgaggctgaagcaggaggattgcttgagcccaggaggtcaaggctgcagtgagctgtgattgcacgacttcactccagcctgggtgacggagtgaaaaactgtctaaaaagttatgaattacatcatgttgtacaccataagtaaatacaatttttacttattgattaaaaataaggctagacatggttggctcatgcttgtaattccagtgatttgggaggctgaggcaggaggactgcttgaggctgagttcaagactagtctgggcaacatagcaagaccctatctctacaaaaataaaataaattagccaactgtgatggtgcatgcctgtagtcctagctatttgggaggctgagcagggaggactgcttgagcccaggagttgaaggttacaatgatcagccactgcactccagccttggcaacagaatgcgatcctgtctccaaaaattaagtaaatacattttt

SEQ ID NO: 447527 - DNA, 5535 bp, Homo sapiens
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447528 - DNA, 5751 bp, Homo sapiens
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattggtaagttggttaataaaagattatgaaaggaagttttacattttattttcaaaagtaatttttaaaaatgtagctggtatgtataaaagatttaaaagatttctacttctaaatatatagttcaaatacatataatttgactcaataccaatttgaaatgaacggctgttgtctttcttaacaaattacaacttcatttttgaaaatttctttcagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447529 - DNA, 3939 bp, Homo sapiens
agcttctaaagaaagtgataccaagtgtcactagaatcagccttacgtcttttttttctctgtacatcagtgcatttcttaagttttcctgtcatctttaacaactgagtcatgaagctcacttttagtgtttcatttgtaacattttaatgctcacaaaccaaataaaggtgaactgtcctttgctattgggttaaatagtaaagagaccacaccaccttttacattgtttgtgtcaagggttttagacccctaacttacttagaaattaatctgttactttgtcaagtgacaaaagatgagagaagactctgcttttgtaaattttatttagaaattagagttaaaacagttatgtattgttgaaatgtaataaagttaagccatttttgttactagtgtgaagctttatgcccattaactatgttttaactttaatttggaatagaaacctgcaggaagttacaaaaatagtacagaattcaatgtagccttcacacagcttcctccaaatgtgacacctcatataactaactgtaatgtaatattaaaaccaggacattgacatagttatattactattaactagatgacagaacttaatgtcttcaccattaaaaaaaatgcatctgtgtttttatgctatttgcccattgacttttaaaacatatttgttttataggaggagtttatacagagaaatcctcttcttatcattagtgtctctaggaagagagaatattgatattggtaagttggttaataaaagattatgaaaggaagttttacattttattttcaaaagtaatttttaaaaatgtagctggtatgtataaaagatttaaaagatttctacttctaaatatatagttcaaatacatataatttgactcaataccaatttgaaatgaacggctgttgtctttcttaacaaattacaacttcatttttgaaaatttctttcagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447530 - DNA, 2703 bp, Homo sapiens
ctaggctgggcaacatagtgggagcccatctctacaaaaaataaaaataaaaaattagctagatgtggtggcatgcccctgtagcctcagctactcgaggctgaagcaggaggattgcttgagcccaggaggtcaaggctgcagtgagctgtgattgcacgacttcactccagcctgggtgacggagtgaaaaactgtctaaaaagttatgaattacatcatgttgtacaccataagtaaatacaatttttacttattgattaaaaataaggctagacatggttggctcatgcttgtaattccagtgatttgggaggctgaggcaggaggactgcttgaggctgagttcaagactagtctgggcaacatagcaagaccctatctctacaaaaataaaataaattagccaactgtgatggtgcatgcctgtagtcctagctatttgggaggctgaggtgggaggatcacttgagcctgggagacgaaggttgcagtgagccatgatcacatcactgcactccagcctgggtaacagagtgagatgttcgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447531 - DNA, 1792 bp, Homo sapiens
ctccgaggatccccgacgagttgtccgagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447532 - DNA, 2321 bp, Homo sapiens
  misc_feature (2276)..(2276): n is a, c, g, or t
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaccggtgtgtatacccgngctgttgtaactggagctgttgaactggagctgtgtaaatggagg

SEQ ID NO: 447533 - DNA, 773 bp, Homo sapiens
  misc_feature (728)..(728): n is a, c, g, or t
agaagtctgtacctgcttcaaatgcaatagcatataaggctggtttaatttttagatatccagaagaggactatgagtcatttccactctcagaatcagatgtacctcttttctgccttcctatgggagctactattgagtgctgggatcctgaaaccaaatatccacttcccgttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctggngctgttgtaactggagctgttgaactggagctgtgtaaatggagg

SEQ ID NO: 447534 - DNA, 412 bp, Homo sapiens
ggaggcagattgcttgagcccaggagtttgagaccaacctgggcaacctggtgagaccctatctctacaaaaaatacaaaaattagctgggcatggtggcatacatctgtagtcccagctatttgggagattgagggtgggaggatcacttgagcctgggagacgaaggttgcagtgagccatgatcacatcactgcactccagcctgggtaacagagtgagatgttgtctcaaaaaaaaaaaaataataataataataatagtaataattgaaaaaaaacttactgtgttcttattgttagattctgaaaagaaatcatctctcctgtcagaggaacaacaagaaacaagcactttagtagaaaccatcaggcagagtattcagcacaataatgttcttaaacccatcaac

SEQ ID NO: 447535 - DNA, 4855 bp, Homo sapiens
agaagtctgtacctgcttcaaatgcaatagcatataaggctggtttaatttttagatatccagaagaggactatgagtcatttccactctcagaatcagatgtacctcttttctgccttcctatgggagctactattgagtgctgggatcctgaaaccaaatatccacttcccgttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447536 - DNA, 5608 bp, Homo sapiens
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgt

SEQ ID NO: 447537 - DNA, 2325 bp, Homo sapiens
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaaggtatcaaagggtacagagacctctttatgtagtaataaatggggtacccttgtaaaaattctgtctctaaagacaacctgactcatataggcataagttctggcatttaagagtacatcttaacttattaccacatagtgtttaacgagctaatgaatgaatctgatgataaaccatttttgaactaagtttaatattttacagttgtcttttacaaaatgaacttctcaacagtaaaatatttcccttttaatatagtcattgccagtttccagaggcgaaatgttctctttctgtgaaatgtacacttggcccttaaatactaattgaatcaaacatttattgagactctattgtatgctaaatattatgctaagctctaaaaataaaaaagtaaatatgactgggtctctctccttaggtggatcgtggcctagtagagattaaatacttgtcagtgtctttattgtacttatttgcatatagcatacttctaggtaattttgtttaataaagatgaaataatatttgagtaaagc

SEQ ID NO: 447538 - DNA, 408 bp, Homo sapiens
aggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggtaagaaagctttatgtgtgtagtctgtctgctattggagtgtttatagtatctttctag

SEQ ID NO: 447539 - DNA, 4148 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447540 - DNA, 3777 bp, Homo sapiens
tataggcgaattgggtaccgggaaaaaaatcgaggtcgacggtatcggatgaagcttgatatcgaattcggggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447541 - DNA, 3821 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447542 - DNA, 3459 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacgctgctggctgggcgctggccttttgatcacaatgactttggcgtatttctttgcaagctgttcccctttttgcagaagtcctcggtggggatcaccgtcctcaacctctgcgctcttagtgttgacagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447543 - DNA, 3235 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaaggtaggaagtaaccacaaatgtatttgcaaatttaaacccatgctctgattccacgtggagagttgctgcagacttttctgacctttggaattttatctgtgtttttactgagagctatttctgctgtcttctaactactagttttaagatttacaaattttattatctgtcttatgttacacttagtttctaccttaattgtaacaaaatagtatttcagggatgatggttcaaaatcatggtgtttcatgacttggattctcatgccacccctgggcttgctggttggataggctgtcttggcaagatccctggatttttatgaaatgcaatttccagagtgagagctactaggcccagaaaatacttgaaacaaacatatccttgagtttagttaccgttgaatatgatgctgttcagaagccagatatctacagtccagcttgaaatgaattgtatttattttattttgactgtctagattaatgattaaagccaaagggcatcctggcttttctcagtgatatgggtgacttagagataatggggtccacatgatagcaggccactgttgaccttgctgagcagcattactaactaataccacttaaaatttgcctgctttactgtggtctccttcatttcttcagtctgcatttattgagcacccactgtgtgcccacccctgagctaggcagtaaggaaccaaaaagaaacacaacaaagtcagtgcctcagtgtgagaggaagataactaaccttgcttacagactgtattaggccatttctacattgctattaaaaaaaaaaaaaaaaggctgggtaatttataaagaaaagagatttgattggctcacagctctgtaggctgtacatgcatggctccagcatctgcttctggtgagggcctcaggaagcttccaaatatggcagagggagaaggggtgcaggcacgtaacatggcaagagcaggagcaagagagaagggggcaaggcaccacacttgcaaaccaccagatgtctcgagaatcactcactaatgcaaggacagcaccaagccattcatgggagatctgcccccatgagccagacacctcccaccagttcctacctccaacattggggattacatttcaacatgagatttggaggggacaaacatccaaactatatcagagactacttagacccaaaacaaactaaagccgaaggaattacatattccatatttggtctagttgttgggagggaaaaattgctgcaagaattcagatatactaaaattcaaatgaaatggcctgatctatgccagattttatgaaatgtgtttattctaaacccaagaagagtattttcctcagccttgttttttccttctatgtattatgcatagaaagcaactattctaagaggtaatattctgaaatattactttaaatggcaagttttgtcaattgaagatacaacacattttaagtaaaacagtaatctctcagtttccaataagtacacttaagctgtggttaaattatattaccctagcagaaaaatcagtggtctgataatatagatgaaaacaatggttacaattttgacattgcaaataaaaacttcccaaaattacaccagtacactgtttccaaaattgaagagattagagaacaaacaatcaaaaaattaccatctctttccacaggatagcataaatacatgtgttttctattagagcttaaaataggaatttagaactaaactatgatgcaaaattgaaaatgtgtaattgatttaaaatgtttagcatatgctacataactttaatcttttcttttaaaaagttttctctttatgatatactatgtgcacacaaccacttgactttctcctgacatttctccttaatgataaattggaaaattcaaattttgactcttcagccatcagagtgtggagtatcaaacattgattattcaaacttatgaactagtgaaccaacccatcatggctcaagaaaataattatccatctctgcatttataactccctgctgctgttcaccctgaagcacactatgtagacttgccatgtgcaaagcagcttcttagccaatcaatatccacaactgctgggaaggatacctgcttatctctttgcggtgctactgccaatcaccagactaaacatcatttctattccatggcaacgttttaagtcagaccatctggaatgtctccagatttggtaaaaatgcaaataaaactttgctttacattcacctagcaatgaataaaaattaacatattct

SEQ ID NO: 447544 - DNA, 362 bp, Homo sapiens
gaaatggcttctgggcaagaaaaatgcttattctaggaagaaatgctagtgagcagattttaaaacaatatattctaattattctacaccattttcttttgctctagtttcttactgctcatggattacatcggtattaacttggcaaccatgaattcatgtataaaccccatagctctgtattttgtgagcaagaaatttaaaaattgtttccaggtaagatgatttttcaagtattttttaaagacaacaaaatgagtatattaaacagtcaacagacacagccaattccagttgtaatattactttgatcagctatactactttttagcagtgaagtgaaaatcatgttttattaccca

SEQ ID NO: 447545 - DNA, 3969 bp, Homo sapiens
ctttttagtggccgcgtcccaggatagctggaattcgcggccgcctcttgcggtcccagagtggagtggaaggtctggagctttgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447546 - DNA, 3949 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447547 - DNA, 4020 bp, Homo sapiens
ctttttagtggccgcgtcccaggatagctggaattcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaagttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcat

SEQ ID NO: 447548 - DNA, 3243 bp, Homo sapiens
agcggggcgggcggagggccgaaagtccagtatgtgggtccaggtcactcttctagagcttccgcaacggaaagtgtgagtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcacttaaaa

SEQ ID NO: 447549 - DNA, 569 bp, Homo sapiens
ctattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaag

SEQ ID NO: 447550 - DNA, 3126 bp, Homo sapiens
agcggggcgggcggagggccgaaagtccagtatgtgggtccaggtcactcttctagagcttccgcaacggaaagtgtgagtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaag

SEQ ID NO: 447551 - DNA, 1835 bp, Homo sapiens
  misc_feature (24)..(24): n is a, c, g, or t
gatgctgagacgactctcttaatnctccaccgctacacgatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcacttaaaa

SEQ ID NO: 447552 - DNA, 380 bp, Homo sapiens
tctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctcttt

SEQ ID NO: 447553 - DNA, 3678 bp, Homo sapiens
agcggggcgggcggagggccgaaagtccagtatgtgggtccaggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcaggtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcacttaaaa

SEQ ID NO: 447554 - DNA, 2709 bp, Homo sapiens
agcggggcgggcggagggccgaaagtccagtatgtgggtccaggtcactcttctagagcttccgcaacggaaagtgtgagtttttcaggaattgttcagatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttgtttggtttggttaatacacagaaatatctagaaatgttctgggactagttgagttgtatctttagtattcaggttgtgaaaaataaagatgtttggctatgcacttaaaa

SEQ ID NO: 447555 - DNA, 2255 bp, Homo sapiens
  misc_feature (13)..(13): n is a, c, g, or t
  misc_feature (18)..(18): n is a, c, g, or t
  misc_feature (22)..(22): n is a, c, g, or t
  misc_feature (36)..(36): n is a, c, g, or t
  misc_feature (48)..(48): n is a, c, g, or t
  misc_feature (51)..(51): n is a, c, g, or t
  misc_feature (57)..(57): n is a, c, g, or t
  misc_feature (63)..(63): n is a, c, g, or t
  misc_feature (2113)..(2113): n is a, c, g, or t
cgaattcgagccngggtncccncgtccatccctggntgtactgtaganttntccctntcctgntgtctcacccctaagctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccanagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 447556 - DNA, 1789 bp, Homo sapiens
  misc_feature (1647)..(1647): n is a, c, g, or t
ctcgccgctggcggccaccgcgtcgctccggcccgggccccaccccaggcgactctgtgaggagcggccggaggccggaggcggaggtgcaagatggacaacaagagagacaaggcgaaggcaggggccgccgcgcggacgccggctgctcgcgctcctggacttctgacccccaggcccccaggctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaaccctgcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagcccgttctgggccctcagcccgcggaacacccagggctcctgcgcatccctcgcagcccaagccgaaaggactgcaggctctgcgaccccctcaggtcacacccccaaggaaggacgcagcccagcactaggaccgctttcttcctctcctttggccacaccctctccatcgggtaccaagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccanagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 447557 - DNA, 2348 bp, Homo sapiens
  misc_feature (2206)..(2206): n is a, c, g, or t
ggcctctactccccctgattcaccccctctgcaggcccctctttcccttcctgcctcaccccctctgcagacttctctctctcctgctgtctcacccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccanagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 447558 - DNA, 2059 bp, Homo sapiens
  misc_feature (1917)..(1917): n is a, c, g, or t
ctcgccgctggcggccaccgcgtcgctccggcccgggccccaccccaggcgactctgtgaggagcggccggaggccggaggcggaggtgcaagatggacaacaagagagacaaggcgaaggcaggggccgccgcgcggacgccggctgctcgcgctcctggacttctgacccccaggcccccaggctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaaccctgcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagacacttccgggcctaccccaggaaccccgtccccggccatggcccgtcggtcccgggctgcgggcaccgaggtggggctcccccggccagctccgagtgcccggccacggcccccgacagagggcccccggaaatcagtgagcagcgcctcggagcacagtaccaccgagccaagcccggctgccaggaggcggcccagcgccggtgggggtctccagaggccggcctcgcgctccctgagctccagcgccacccctctctcctccccagcccgttctgggccctcagcccgcggaacacccagggctcctgcgcatccctcgcagcccaagccgaaaggactgcaggctctgcgaccccctcaggtcacacccccaaggaaggacgcagcccagcactaggaccgctttcttcctctcctttggccacaccctctccatcgggtaccaagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccanagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 447559 - DNA, 807 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447560 - DNA, 712 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagtgattctcttctaccttccttagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447561 - DNA, 400 bp, Homo sapiens
gtgcctttctctgtgccggagtcctgtgtctcccaaggcctctgtatatggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447562 - DNA, 494 bp, Homo sapiens
acctacagaatgggagaatactcctattatttctgaaaaaacaaggctagtgaactttagcatagactatatttctaatattgtgttaaagccaggtgcagtggttcatgcctgtagtctcagctactcaagagggttgggtgggaggatcccttgagccctcgagaccagcctgggcaacatagatagactccccccacatctctattaaaaagattatgttaaaataataagaataatatgttatgtaaagactagggcttccagtgtcaaagtacaaaccgctgtctatttttgcttctcttctagggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447563 - DNA, 474 bp, Homo sapiens
cgcgggtgtggtttttctaaattttggcggaaaaatgcaagaaaaaaatttttcgaaaagacccccccttctttttctatatacatcctcctcccccccggggatcaccccaccgatttttttgtgacacattattttagtattttgactcccccacaatatccctcctcgttccctcgtggagtttccccctaagaaaagtccccacacagtggtgtccccgcaggaaaaaacccttttttttagaaaaacccccccggtgggcgtgtttttgccccacagcataacaagcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447564 - DNA, 710 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447565 - DNA, 785 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447566 - DNA, 1923 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgtaagtcatagaaataaaaaagcaagccaagtgtggtggctcacatctgtaatcccagcactttgggaggctgaggtgggtagattgcttgagtccaggagttcgagaccagcctgggcagcatggtgaaaccttgtatctatttttttaaaaagtaataaataaataaaaactttgaaaaaaagacattactagcaactggagatacgaatgtccagcctaactaaactgcctgtattgacttttggaaaaatcagcccctattttctgccactctgcatttcttagttcactcaacactttctgatatacagcttagcagttgggacttcttcttagaccatccttaaagcatggactaagagggactggcaggatatataatgagattatcaatagcagagcctctgcatgatagatcatttatggatttttattttcttcttttgccctggccagtcttttcaaaatgttttctacgatggatataaaaaatgagtaatttttaagaatcaggggatttctaataatagagtaaccacaaacttggggtttcatcttccttcacctggtatcaatagatcttttatgtacaaaaaggacacattttagttgatagtctgaaaccacattcattcctagcaggaggaacagattcgagatctcttccataggagggtccctctcctttgtgacctctctcctataggcaagatggactgaagctctccactactccaaggccataaggaagattaggggcatttctacccagtgatttggaagctacctatagccacaacccagccaccttcccctgcccccgtggcctcaaccgtttgcttgacaggtgggccctctctggccatctgtctccaggacagcactgtggcttgctctgtcctggcccttccaccaccagtgcaaagttgagatggggaagtctccagttcccaatcctgttctttttaaatagagacttcattctcagagtcttcattcattgatttagcgtggtccttttaattttaaaattaccagcgttgatttttaaagctctagaaaataactaatggagaagattctcaactaatctctcccaacctgcttttacagttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447567 - DNA, 1486 bp, Homo sapiens
tgggatgacaggtgcaggcccacatgcctggctaattttttttgtggttagacatgaggtctcactatattgcccaagctggtctcaaacacctggcctcaattaatctcacatctgtaatcccagcactttgggaggctgaggtgggtagattgcttgagtccaggagttcgagaccagcctgggcagcatggtgaaaccttgtatctatttttttaaaaagtaataaataaataaaaactttgaaaaaaagacattactagcaactggagatacgaatgtccagcctaactaaactgcctgtattgacttttggaaaaatcagcccctattttctgccactctgcatttcttagttcactcaacactttctgatatacagcttagcagttgggacttcttcttagaccatccttaaagcatggactaagagggactggcaggatatataatgagattatcaatagcagagcctctgcatgatagatcatttatggatttttattttcttcttttgccctggccagtcttttcaaaatgttttctacgatggatataaaaaatgagtaatttttaagaatcaggggatttctaataatagagtaaccacaaacttggggtttcatcttccttcacctggtatcaatagatcttttatgtacaaaaaggacacattttagttgatagtctgaaaccacattcattcctagcaggaggaacagattcgagatctcttccataggagggtccctctcctttgtgacctctctcctataggcaagatggactgaagctctccactactccaaggccataaggaagattaggggcatttctacccagtgatttggaagctacctatagccacaacccagccaccttcccctgcccccgtggcctcaaccgtttgcttgacaggtgggccctctctggccatctgtctccaggacagcactgtggcttgctctgtcctggcccttccaccaccagtgcaaagttgagatggggaagtctccagttcccaatcctgttctttttaaatagagacttcattctcagagtcttcattcattgatttagcgtggtccttttaattttaaaattaccagcgttgatttttaaagctctagaaaataactaatggagaagattctcaactaatctctcccaacctgcttttacagttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447568 - DNA, 321 bp, Homo sapiens
tctgctgcctgcgccagtcagtgaatcactcccactctccgactagaattcttctgttgcctaagtccatcagtgttcccagtgagaaagcactcttggaaactgataattgctttgggctgcctctggtagagaacacacactgtgtaacaagtgaagagacctccctgttctcttctgtagaaaacaaagtgggtgatttttcaatgacctcagttagctcaccatataactttccttacaagcctgttgttttgtccaaaatcaaaactgcacatccacagagcagagatctcaaagattatgcgagaatgtcaggaa

SEQ ID NO: 447569 - DNA, 689 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447570 - DNA, 860 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaaaacgaaaaccacagacccacacaagacaccacgaaaacaaaacagcccccacg

SEQ ID NO: 447571 - DNA, 1435 bp, Homo sapiens
  misc_feature (1127)..(1127): n is a, c, g, or t
  misc_feature (1386)..(1386): n is a, c, g, or t
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaaattctgtgtctgtgactttcgaagttttttaaacctctgaatttgtacacatttaacacttcccccgtacttccccccccgcgcctcctcccggaacacataaacacccgcgctcgcccctctcccgcgcgccgctctgcgcccgttccgccccccgtcggcgtattctccccttccctcccgtattcctctccccgcccgcccgctcccgcacctccctccccttatttacccccgcgtctttccccccccccttttgtgccgcgattcccacactatgagcgcccgccgacacccaccgaccgcacctatttgccccccgttcgctctccctttgtactcgccccaccctcacatcccgcacccgactatcgctccccccaaaacccacgcaccaccgtccccgacctcttccgccaccntcactctccgcccccccccgcatccgcatcatactcatcttccgccgtcttatttcccgcgccgtcttcgtccgccgcccttctcttagtccccgcatcccccattcttttctcgcgttccgcgttgtccgcgcctatctcccccgtccccgctttctccattacacccgcttatctccgccctatgtatacatcgacgcgccaccaccgacgcgatgcacaccctatgtcgtcacgattgtcatccagccgcgtcgtntgaccccgtctcgccgtgttcgaatcacgtctcgccgttcccatcaccg

SEQ ID NO: 447572 - DNA, 592 bp, Homo sapiens
agcgggcaggcgagggggcggagcaagagaagaaaacacaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaacaaaaa

SEQ ID NO: 447573 - DNA, 1076 bp, Homo sapiens
gagttctccagcatctagctagttctaccataggattaatacccaaaaccacgtgggtggagctgaaaaacacgatgctgtggggggaagaacccaaaaagccatagtcggtctgatgtccatttataggacattctagaagaagcaacagtggcgatgcaaagcagttgcctgggaaaggagtggaacaggacagaatggaatgcacaggagcgggggaactttggggcagtggtgggacaatttcatatcttaataggagcggcggcaacatgacgtatacagtcgccccaaatcatcaaactgtagtttctaaatgggtacggtttattaacattcaaattataagaaaagtcatttcctcaaaagtttcggggttgggggaagagttaaagaaggtcgtggctaggtggttgttgaggaataagggagaaaatcacagtttacaaaatctgagagctgaatccgtgctgtttctcgattgagaagcagtggacatcagcagtaggaatggctcaggtccaagaaggctatgccctaccagacccggttgatgtgcttccccggatttactctgtcccaccgtccacctccaccccggcctgcacctctcgcttagggtagaggcctggcctccagtgccatctcccgacagcctcccccaggtgaaggtcatgcttcagcactgcctccctgacagaggctctgatgatgggatgctctgactcagactcaggtgagaaatttgaaggaacagaatgctcttgcctagcagttgccgggaggggtcaggtgctgcccccagagaagtgggagagttagaggtccgtgaggcatactttccccaaagggggcagaaagcatgaagtggtcagcatagaaactcgtctccctgccatccacacagtcccaaggcatgctggttctacatggcttgtctggaagctgtccttgaatgtaaagttgttttcagctcaataatgtatttgcctgccttcgcctttcctttcacccttaccaccttggaattgtaccgcctaataaaatcttcgcacttaaacttggaaacaggctct

SEQ ID NO: 447574 - DNA, 1888 bp, Homo sapiens
  misc_feature (1565)..(1565): n is a, c, g, or t
gatcaattccttaagcccagaccaaagcctgccccgctggctttggtctgggcttcagtgatcaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtngaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgagccaagattgtaccactgtactccagcctgggctggacagtgagactttgacagtgagactgtcaaaaa

SEQ ID NO: 447575 - DNA, 3142 bp, Homo sapiens
  misc_feature (2819)..(2819): n is a, c, g, or t
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtngaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgagccaagattgtaccactgtactccagcctgggctggacagtgagactttgacagtgagactgtcaaaaa

SEQ ID NO: 447576 - DNA, 3368 bp, Homo sapiens
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagtaagcatttgtgtgcacattttgacctattaatgagatgctgtaaaataagtaagttgatttgctttttgagttttggacgactgagtctgatgctgcctagggaggactgggctgttctcatgaccatccgctcacgctgttggattcgtgcatctctgggttagtcgtcatgttcctattaatttgcctctagtagttcctcattagaacattttatgatatataaagattgggggtttggggttttttttttttgagacagggtcttgccatgttgctcaggctggagactggggagttttgactgaaagtatctgatgaccttgtcagtggctgttggttgtcacgaattgcttaaaaatacataaatcttcataataaagctattctgattcttcatttaaaacatcctggtatagtttgtataattagttgtaataagattttaaagatcctgtaatcccagctacttagaaggctgagacaggaggatcactttagcccagtagttcaagaccagcctgggcaacatactgagacccccatctcatttaaaaagaaaaaaaaaatctttaaatgtacctgtgtagttttatgaggtacttctaaacaatgtaatgttaatacatattcttttatttgcttcaaactaggatgaaatacagggagaacatggttccttttaggattctgataattagggttttattttctaaactagagtttctagttggagtggaagtcctgagttccctttgcctctctgtggccttgccgttttgccgaaaacctcccatctccctagtcacccttggtctctaaaagggctcttttgaggagaactcttattctctagtcagcgggtctagcttatcctttgtactcgaaggacttcgtttatttttcctctggttgacttcatgtgttgaaaattttggcctatcaaactacgtgtattaaacaatagtttttcccattcttattcctcaaaatcatgagttatgagtctaagcttttaatcaacatgaattgataatcaatgcagctgaaactcagttggttctttgggccgccttcgccgcctgcgctgccttcacctgagtgctctacgtggggctgtgctgtttgcagtggagctggtgctcctctcctgaggtacagagtgtctgcctctgtgcagaggtggcagcctcagccgtattcggatctcaccagaaactggaagcagcccacatacccctcagttggggaaaggataaaccatgagacgccgtctaagggatacttactacttggcatcacgaggggcaaactcccaaggccccaagagcatggtgact

SEQ ID NO: 447577 - DNA, 2499 bp, Homo sapiens
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaagctttcctttaccttttaaagaaggctacttagctctatgatttaggaagaaagattcattctctccacccccagagagagagaacgcccaggaggtggaatgttaaccactggagaacttggagaggtttatgcgggtgaagtgtgttcttggaacttttctgtaagtgtataattgtttcaaaatagatgttttgaaagcattcataa

SEQ ID NO: 447578 - DNA, 1047 bp, Homo sapiens
  misc_feature (724)..(724): n is a, c, g, or t
cagctcagccctgacatgtgtttatacgattcctttccagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtngaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgagccaagattgtaccactgtactccagcctgggctggacagtgagactttgacagtgagactgtcaaaaa

SEQ ID NO: 447579 - DNA, 222 bp, Homo sapiens
tctaatttggttcatctggtggcccacttgttgaagacaaaatcgctttccctttccatcttaaagtaaaggttcgtgtaacgtgtgaaaatattgaaagcaatggaaatgggagtgtaattgtttagtacctggtaaatcaggtcctgttttaccagcgtattttcttcgattctgattcatctgaaaagtgcttgcattatcctagccaggacagaaaac

SEQ ID NO: 447580 - DNA, 3407 bp, Homo sapiens
  misc_feature (3084)..(3084): n is a, c, g, or t
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtngaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgagccaagattgtaccactgtactccagcctgggctggacagtgagactttgacagtgagactgtcaaaaa

SEQ ID NO: 447581 - DNA, 1799 bp, Homo sapiens
  misc_feature (1476)..(1476): n is a, c, g, or t
gtagtgagctgaagtcatgccactgcactccagcctgggtgacagagcaagactgtctcaaaaaaaaaagtaagaaaatgtgaagtcatcgccatagcaggaaccagctctaagggcacacacgattgagtcagtttattgtcagccgggcacagctgtcgacttttgcagcgacgggggaccccctagatggtcttgtctcctctgacattttgccacattgtaggagaacctgaggaccagagaggttgtgacagggctgggcccctagctggtgtctgccgctgcctccacctcctttacgtggctcgcctctaaccagacccttccaggcgggaagatgttcccctgaaaggtatcagccattaaactttggaagtcgagtgatgttccagtcattgctgttctgttttctaggcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtngaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgagccaagattgtaccactgtactccagcctgggctggacagtgagactttgacagtgagactgtcaaaaa

SEQ ID NO: 447582 - DNA, 2484 bp, Homo sapiens
  misc_feature (2413)..(2413): n is a, c, g, or t
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgagaanccaaagctgggggtgttacgtgagggggctctggatcatctgggtacgagctcaatcgacgcggggaacaa

SEQ ID NO: 447583 - DNA, 2297 bp, Homo sapiens
gtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtagggacacccatgctcaaggctgccaggcagaggcacccccctgtgtggtgtgtggtcctggctttacctggagcagctctcttactgttcttgaatggtcactgaaatgtacaaggtttatctggaggccttacagaaattgctattaatattacattgtgatataattattccatttctgttgtatctttttattggactttaaaagatctaaaagttgaatggcacggggcaggggagcgcatgaggacctgaacgctcacggggcaggagtccgttgctgagacccctcaggctgccccccgggctgtgcattctaggctacaggctatggatttcacattgtggaaattcaagcccatttttcatccagacttccctcgttatcccc

SEQ ID NO: 447584 - DNA, 3736 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447585 - DNA, 3333 bp, Homo sapiens
aatcagtcggtcaccactaacatgaccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447586 - DNA, 4150 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgaaaaaaaaaaaaaaaaaaaaaaaaaaaaatgtgtgtgtgggggggcctggggccctgggagaaagttttttgagaaccatggggtgtggggcgccgggggcccagttgaggttaaggtgaccgtggggccaaagggggttcccaagggaaacccggggccaggacaaggggcggggatttctcaccaattaaaaaaggccggggggaaacgcggagggtccgggaacaattcccgaggaggggagtccgggagggccaaacacaggggggagctctattaacccggggaggtccaagggagaagcccagatataaaattagcccgggcgcgcggggcgggcaccaacaccgccacacacacaagaaacaagaacaaaagaaaaacaaacaaaaccaacagaagaaagaaaaaggg

SEQ ID NO: 447587 - DNA, 2719 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatacttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447588 - DNA, 4159 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaagagggggcgggcgccggcacgcgcgcacacgcaagaaagaaaatatatcaaaacacaaaaggagggtgggggacgggcgggcgagaagaagaggagaatcagacaacgccggggggagtacatgatgctcatgacaacaaaacaggtggaggaaacaaaaaagcaagagcagggagagaaaccacgaaacgaaagacagcagggcggagagaagacacgacgaggagtgaggcagaaacaacacgaacagagaaggagacgacaacagacaaaaaaaggaggtaaaacacaagaagagagaccagaacgagaagaacag

SEQ ID NO: 447589 - DNA, 3681 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgtcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447590 - DNA, 1217 bp, Homo sapiens
ttgcgtcaatcatggtcatacgctgggtctgctgcgaggttgatatccgcgataccaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447591 - DNA, 1286 bp, Homo sapiens
gatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcagaggttttgccgttgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggttttggaatccggatgctgttgaagggcaatagcagactcctccagctaagagacaggacatgttcttgagccactgtagctgttgaagctggacaccagacgctcccaatctgaagtgggagcggccgcaagctt

SEQ ID NO: 447592 - DNA, 389 bp, Homo sapiens
  misc_feature (45)..(45): n is a, c, g, or t
ggcagaaccagtcccttgtgtatggcaaagtggatagcttctggnagaataagaagatctacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 447593 - DNA, 549 bp, Homo sapiens
agcggccgcctactactactaaattcgcggccgcgtcgacccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447594 - DNA, 515 bp, Homo sapiens
agcggccgcctactactactaaattcgcggccgcgtcgacggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447595 - DNA, 665 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgcctccgccgccaccaccacctccgccaccgggcccgccgctgggcccggacctcagtgctgggacgtacggtagtgcttgctcatggcgctgctcgagta

SEQ ID NO: 447596 - DNA, 386 bp, Homo sapiens
agaaaggaactgtctgccacaagcacgagatgacacactggttagaacatggagctctggcacctgcagcctaggctcaaatcctggctctgtcacccccagctctgagactctagggaagtggcttcaactctaccctggagccccctctaaagttgaaataatactgttgttacccagctcctgggattgctctgagagggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaaggatggatccttaagtgcaag

SEQ ID NO: 447597 - DNA, 839 bp, Homo sapiens
gtgaccgtaaatctcattctctccaaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtggtgggtttcctctgggggcttcctctttcggcctcggatcatattactttggcggtcctccagaccaacctctctggaccccattaattcaactgccttctagtgtgcccctctggcccttcaagctcaacctgtctgagaaccagtttatcatcattaacttccaacatgtttctcatcttgtgtcagacctcgttgcattttcagggagctcagggaatattaggaggctcatagatgaagaaaaataaaagagaattgagttcccatgtgcggtgagacaggagcatgcacataactaaaggagcatggtgaggtgggcattcgatcttgcagcaggtatgggaaggaggcatttaggaagaatgcatggaa

SEQ ID NO: 447598 - DNA, 649 bp, Homo sapiens
tgagtgtctgtctgctgacaacaaatccaagtaccattgtacccttagcatgtccctatagccaggagacccatctggcacctcagccagtggaaaattccctctaaagggcattagcaagaaatgtccactggaggctggggtctctttgggacaaaaggaagggaccagagaagagaagtcctaatctggcttggaccaaccttccttgcccctctgtttcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaatgcggtgaagcattgttgactctaatgtgtgaatccaaggcaattcgttggtaacaccaactatatcttaataatctttctaaggtttgaatcccaggctgctgtttccattcaacaaatgtttatgagcatctgttatgcaccaggccctgtgctgggtgctggagaaacaaggactttgctcctccagaaggagagaa

SEQ ID NO: 447599 - DNA, 498 bp, Homo sapiens
cgagtgcaagtgggaagtgattcaggtgatgaaaggaaagacaaatttccctcatggatatttctttcttctcatttgcccagaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447600 - DNA, 555 bp, Homo sapiens
aaattactttcttcataagtcaccccaggaagcatataagtcatacatacgagcctatgattccccgcttgctctgacgtctgagcaagctgggaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcagggctgctcagacggtaccagctcgatctaagttg

SEQ ID NO: 447601 - DNA, 351 bp, Homo sapiens
tgccctgagtatgacacccatgtctgaccagctctggttttgtactagggagctggaatagagctgcaagaagcttctgggttacatcttacgtgggaaacagagttttcaggcctaggaagagcctgtgtcaagggagatggggctattgcagtaatggtgggtacccagtgacagcacactcaagctcataaaaataaacatcttcctttgcaggtctgacacccttagaaggaactcaagacacctttaccaattttcagcaggtttatctctggaaaggtgagctccgtggtggaagagggggttagcaggacgctgattacatgagatgtctgcacctctcctctc

SEQ ID NO: 447602 - DNA, 753 bp, Homo sapiens
ataagctctgctgagagttgtcgagacaaaccaaatcaaaccattaaaactataatttaaaaacatactttatcaaaaacactataaatgaattgatttccagaatgcatattcaattcataacttaattgcagagttgacagtgtatctactgtatgctatccacatggcacatgttaaggagtagaaatgaacaaaattagtttggcatagatctatgtgtccaggtcaggatctatatctccctattttaacagtggggccagagaggtggtaataaaggctgccatttattgagcaatgtatgtttacaaggattatctcacaatcccaaagccacccataaactggccattgctatcctgagttacagaagacaaaaatagttttaagagtgtaagtgacttgctcactgacatagaaccagcaaggggtaagggcttaaattcaaacccaaagtaacaacatcaaagcctgcagtctttttttgttttaaatgattttatctttggggtgcacgaaaatctcagactttaccactatacaattcatccatgtaactcaaaaccacttgcatcctaaaagctattgaaataaaaaatattaaaaaataatctcatctttgattttagatttagggggtgtgcatgcaggcttgttatatgggtatgtggtatactgccgaggcttggggtacgattgagtccctcacccaggtagtgagcgtagtcgcaatagttagttttacaaccc

SEQ ID NO: 447603 - DNA, 514 bp, Homo sapiens
tttttttttccaccccaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcaaaaaaaaaagtcgacgcggccgcgaatttagtagtagtaggcggccgc

SEQ ID NO: 447604 - DNA, 628 bp, Homo sapiens
ttgccatcattttagtgagatttgagttaggaaatgaggtttaatatgaatttaatatgtcatctttaattggaaactttcagtctgtattttactcatttgtcctcatattttcatgactacagcaaatctctaagtaatgtattttctttcttcctctatgaagttatactggaagataaagtgaagaacttttacactcgcctgccgttccaaaaactgatggggatatccattagaaataaagtgcccatgtctgaaaaatctatttctaatgggtaagctacttgtgtctcacccctaatgtttattatgaataatacttcctcaaagaagatgacacaatcacagctaaaaacagaagcatacccagcactttgggaggccgagctgggctgatcacgaggtcaagagatcaagactatcctgaccaacatggtgaagccccgtctctactaaaaatacaaaaattagctgggcatggtggcggcacatgctagtagtcccagttactcaggaggctgaggcagaagaattgcttgaactcaggaggtggaggttgcagtgagctgagattgcgccactgcactccagcctagcaacagagcgagactctgtcaaaaaaaaa

SEQ ID NO: 447605 - DNA, 445 bp, Homo sapiens
gtggctcccttttccactgtaggatgttcagcagcatcctgacccccacacactagatgccagtacaatcctttctcttcccagttgtgacaaccaggaatgtctccaagcattgccaaagggttctctaggggaggtagagatggggtggcaaaatctcgcctgctgagagcccctgggctgagctgagggtaccacatgcttgagctatctttgcgggctctgacgtcttctaaaatgcacaatgattttatgttccattccacagtatattgtatttaactccactgtatattgcatttacgttactataaaatgttttgcttccatgtctttaagtgaaattgatgtcctgggaagatgtttatttcacaggttttttgatgcctaaaatacatcagcatggacgccagttttcgagcccaccacctaccagagggaactg

SEQ ID NO: 447606 - DNA, 4661 bp, Homo sapiens
gctcctttcgcgtctgcaaccctggcttgttccccgcttagaggatccgtctgagcaagctgggaatcacagctgcctcagccccgggcctgccaaggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447607 - DNA, 7826 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447608 - DNA, 7880 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447609 - DNA, 8067 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaaaaaaaaaaaagtcgacgcggccgcgaatttagtagtagtaggcggccgc

SEQ ID NO: 447610 - DNA, 7955 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccatgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447611 - DNA, 8080 bp, Homo sapiens
  misc_feature (8021)..(8021): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaactngatcggccggttgtgcatctccccgccacgaatcgcaactattttttgtagaaccacga

SEQ ID NO: 447612 - DNA, 8071 bp, Homo sapiens
  misc_feature (6008)..(6008): n is a, c, g, or t
  misc_feature (6010)..(6010): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgntncccaacatgaggcctgtctcatcaccactctgcaaacccatgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447613 - DNA, 7821 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcaggatgagccaagcgcgggcagtcggagg

SEQ ID NO: 447614 - DNA, 7781 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgttcaccccctgtagacgtctcgcctgctcattcttgtctcccctacatattactc

SEQ ID NO: 447615 - DNA, 7625 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggggtaacctcggtaccgagcttg

SEQ ID NO: 447616 - DNA, 7680 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggtgaaatcccactactatcacaagaacagcacgggaaagacctggccccatgactattacctcccatcaggtccctcc

SEQ ID NO: 447617 - DNA, 7883 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447618 - DNA, 7704 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccggtaagctaagctgcaggagggtgcagattcctactgctatgttttggagcagactcagttggtgttcaggtcatgaatgagaaataaaggcacgtggctttgtgcttgaggtttcctctgcatcattcattcagcctacagcatggggagtgtccctgctgaggggaagccctggaggacatgtagggtggaccctgctgccaggaaaccccaagccaatgagagaaatgagggggtgactctggctcttcctgggccatgagggagctgtcggagggcagagacgaagcacttgccagaagtgcctggtgcacgctccacctgaagcagccgctcagcaaatg

SEQ ID NO: 447619 - DNA, 7258 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatggtaagtggtgtgtgttctaccttcagtcttactgcagatgcggctgggggaggtggttctcctggtgctgcaaaagtctagttggcttcaattgcttgggtttcccttgtcctttgtcctgagtgtggatgctgcttggagttttccatgtatgtgtgattccacaatgctgaagagctctcctgacttttttccactcacgtctgaagtgctaaaaattttagatggtgaagtgtttctatttcctgagagtggttcattaggatttagtgatctgaaccatcaattatctctcttgtcaatgcatgatggtaaagaagagaactcactgttcgcaattcttctggatggcctgaagtgccggctacgtgaggctgatgatgatggtgatgaggaggaggatgatggtggta

SEQ ID NO: 447620 - DNA, 6794 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagccgtcgtaggcagagaggggaacctgcagagacgacca

SEQ ID NO: 447621 - DNA, 6683 bp, Homo sapiens
  misc_feature (6646)..(6646): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctggggnccgaaagtaatgcactggggctgtgacagtgcggttt

SEQ ID NO: 447622 - DNA, 893 bp, Homo sapiens
  misc_feature (12)..(12): n is a, c, g, or t
aatgttgatccnctgccccgactatagaggatcccgtctgagcagctgggaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447623 - DNA, 900 bp, Homo sapiens
attcctgctggctgattctagagtatccccgcacgggccatcacagagcaagctgggaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447624 - DNA, 6394 bp, Homo sapiens
  misc_feature (6361)..(6361): n is a, c, g, or t
  misc_feature (6363)..(6363): n is a, c, g, or t
  misc_feature (6393)..(6393): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgccctgcaaaaggccttcagcccaaaccctgactggcagctctggatncncagcaaggcactgtgagcagcccaacatcnc

SEQ ID NO: 447625 - DNA, 644 bp, Homo sapiens
gagcgatctagaggatcccatccccgggttgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447626 - DNA, 6055 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttctcaacatccggcctgtttccttcagtctgggtgcgagctcgattg

SEQ ID NO: 447627 - DNA, 7062 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtttaaagtccgggaggtgagagggacccagctgaagaggatggagtgagggcttccgtataactggagtacctggtgtcatgggaagattcacatgtacctggccaaacgaacaactccatgttttccaaaaggcttggagaacataccaggtacctctcctctttccctttgtgtttgtcattttggcgaattactggaagatggtggttccagctgaaaggctttttggcaatttttaacagctgaaaataaaccttgaaataaacattttctcctttaactgatgtctgggaaggaagaaacaaaaaaagaaagagaagaaaggaaataaggaaggagggagggagagagtgaaggagggaagaaaagagaattaaacacgattatctacatatcaatggaaaatttcaaatatattctagcataatttttttctacttagtatccattaaaaaagggaatcattgtggaatgcttaaatcaatcaaatgaacacagccatccctcggatacttattttttttttttttttgtggtgagaacatttgaaattgattctcttagtagtttcgaaatgtgccatatgttaactatagtcactgtgctgtgtaatagatctcaaaaagtactcctctgcatcatatacatatatcataaccttgtattataccccataaatatgtataattataatctgtccgttaaaaataaaaattaagctttaaaaaaggggatatggtgctttctagaaaggaatagaagtgcctccatgtcacccagaggcccgcctgtgcagagactgcagctgtgctgcctccaggttgtgaggtgacccaagctgcccccatcacctcctgcctctttgctgcccccatcatccctcccagacccttccttctcctctgcccttgtcccctcagcagctctggtttgcagggggtatcaccatatagggctgtcctgggtgcaaacactgacttgctgcctgcctttcagctgtttggtcttgggcaagtcagtggccctctgtgaacctcacttttccctcctataaagtagggttaggacagttcatctcaatgaagtaccattagatggaaccagttaatctttacatgactttttaagcacttcttacctgctaaatagatagtagcactcattgctagtctatctggtcacagaggaaa

SEQ ID NO: 447628 - DNA, 6381 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagggatcatgaaggtttgctgggggcctgaaagacttttcctgcctgaaaggtttcagaatgtcacggtttaccccagccagcctgtgcaggtgtggaaaccgcctcttctatttcccagctattccatattcaggagcaatcacttgatgagtgctgagcagctgaaagaaattcctcttggttttgattgcgggaagaagggtgaggatcctgaagacttttggatgccttggactcactgtttatttttgatgagtcctaagaaagtcatgtgatctttttatacaataaatgggatgggtctgtgattatttgaacgttggagagagtgtcaggcatttgctgccggtttgacattctgcccttggatctgatacaaaaatgcttggaggcactttccgcctgtttttcaaatgagggaggcaatggccagagcagaagctcacctgtcattacctgccagcaagcggcagacctctgcctgtggggtgcatgcagctctatagtgatgtg

SEQ ID NO: 447629 - DNA, 6172 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaaggtaagttcattgtctttttatctcttggatgagagtaccccctcattcatcttctttctcctcttcccccttgcttttgtacagaagttgatagcttgcatatcactcgcattaattccagctcctatgaattaaacacatgtataagtggggtgagtaccagcaacatgcccactttgcagatgagaaaattgactcacgggaatgaaatgatttgtggaaattatgtggctgattgaagcagagtaagacctaagtcgcgtctcccagttttcattttaaggattatttcgccctatcgagt

SEQ ID NO: 447630 - DNA, 5118 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtaagtctttgccatttgtccatattctttcaaaattactcttcacacgagcaaggccctctgctactttcttatgagccctccttgtggcctgaggagcttatacttctg

SEQ ID NO: 447631 - DNA, 4711 bp, Homo sapiens
  misc_feature (4650)..(4650): n is a, c, g, or t
  misc_feature (4653)..(4653): n is a, c, g, or t
  misc_feature (4678)..(4678): n is a, c, g, or t
  misc_feature (4690)..(4690): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaaggggncangatcaccacacttaaaccttgaccntggttcaaaatntttgtgcaccatggttactag

SEQ ID NO: 447632 - DNA, 4367 bp, Homo sapiens
  misc_feature (4255)..(4256): n is a, c, g, or t
  misc_feature (4260)..(4260): n is a, c, g, or t
  misc_feature (4271)..(4271): n is a, c, g, or t
  misc_feature (4280)..(4280): n is a, c, g, or t
  misc_feature (4286)..(4286): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcacttgatgcagaagtttgagaaggttccagaatcaaaggtgatcttcgacgccaatgctcctgtggctgtcagatccaaagttcctgattctgagttccccgtgatgcagtgcttgacagattnnacanaggacgaggcntgcagcttnttcacngtgtccagcgacggtagccagagatattcctgtgaatgctatgcttgtacacgaatgtttcggtaccgtgctgaatcgtat

SEQ ID NO: 447633 - DNA, 3026 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaagtaagggtctggaagcacaggattggagccgggacttgtccccgctggtcagagatgatttttctttttgttcaatacgttcagcttagt

SEQ ID NO: 447634 - DNA, 525 bp, Homo sapiens
gctcctttcgcgtctgcaaccctggcttgttccccgcttagaggatccgtctgagcaagctgggaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcagggctgctcagacggtaccagctcgatctaagttg

SEQ ID NO: 447635 - DNA, 1801 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaatgcggtgaagcattgttgactctaatgtgtgaatccaaggcaattcgttggtaacaccaactatatcttaataatctttctaaggtttgaatcccaggctgctgtttccattcaacaaatgtttatgagcatctgttatgcaccaggccctgtgctgggtgctggagaaacaaggactttgctcctccagaaggagagaa

SEQ ID NO: 447636 - DNA, 1056 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtggtgggtttcctctgggggcttcctctttcggcctcggatcatattactttggcggtcctccagaccaacctctctggaccccattaattcaactgccttctagtgtgcccctctggcccttcaagctcaacctgtctgagaaccagtttatcatcattaacttccaacatgtttctcatcttgtgtcagacctcgttgcattttcagggagctcagggaatattaggaggctcatagatgaagaaaaataaaagagaattgagttcccatgtgcggtgagacaggagcatgcacataactaaaggagcatggtgaggtgggcattcgatcttgcagcaggtatgggaaggaggcatttaggaagaatgcatggaa

SEQ ID NO: 447637 - DNA, 481 bp, Homo sapiens
ggtgggctttgaggtgaagagaccaggtggtaactaattggctttagagatgagaagaagctcgagtgcctgagctggacatcaagctacacgagacattcatgcttaggtgtctgttaaaactgagagcagatgggctcatccaagtagagggcagggcagagagaaaggggagcaggcccaggccaggccctgagagcttgacaggtccagggaaggggagaggaggagggcccagtgtgagtgagaaggagacacccacaagcaggcatgctcagtcgtcccgaggctgggcaggtgcccaccacggctccactttccttctcccaggcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccatt

SEQ ID NO: 447638 - DNA, 653 bp, Homo sapiens
taatgatgttctatcactgagaggttggatgatgttccatataaaaaagagtgcagatccatgtcagggcatctgttgcagatcttctctaagtcacctggctttagggcctgatttttctcacattgctactaccattttgttgaccagtggagtactacccattctccccaacattgcaacaactcttttttttcctcctagattctgacatggggtctcggcctgagtctatgggatgtagaaaagacacagtgccaaggccagcatctccaacagaagcaggtactgacccccaaaccttcttacacacttgggtgtctgaatgcagagactaaatgggtgcaccaagagtttaatcaatgaacggatgtattgacatcactctattctgtatccatggactctcctttaatcttttaacccaattatccagctcataaatatgggaagctcctcagatgggcaattgtcacagaaagtaaggcaaaatcactgcaaattcataagtgttactggaaatgaagacaaccataataataaaacctgaaaaaagaaacaaagagcaaggttcacctgactgtggccaatgggcttcacttatgtcagccctgaaaagtataaacaaagtgtaaatattctgaaattgtttc

SEQ ID NO: 447639 - DNA, 530 bp, Homo sapiens
ctggtggatgggaacggcaggcgagtgtaaaagttcttcactttatcttccagccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttgccatggccgtagttttcaggagcatggtacatgaagacgtttcctcgggccctctttgcccaggcactggccatgtcgattatagggcagatgataaagtagtcccgggtggcattctccagagcccgggagaaggaggcatagtcatccgtggag

SEQ ID NO: 447640 - DNA, 535 bp, Homo sapiens
  misc_feature (12)..(12): n is a, c, g, or t
aatgttgatccnctgccccgactatagaggatcccgtctgagcagctgggaattcaacgaagcaacctgctgtcctagtaggatgaagtccatcacacagttccagaacagccaaggagggcagtgcggagctggctcaaagtgacagggagctaccagaagaagcagttcagaagaagagaatgtgagagtcagccaggaagtccagctcttctctgacatgattttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatccccaaataacccttatgagttcccagcttgctcaggtctgagcaagcgggcattccaggtatgcaccatcacgtagggctacttcaaaaattttttttcgtagggacagggtcttactgaattgctcagaa

SEQ ID NO: 447641 - DNA, 8457 bp, Homo sapiens
gcaagcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447642 - DNA, 669 bp, Homo sapiens
  misc_feature (12)..(13): n is a, c, g, or t
cgatgctgcggnnatttagaggatcccgcacgaggggtgtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggccctaaccgtctggctggggtctccacacaccatg

SEQ ID NO: 447643 - DNA, 8018 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447644 - DNA, 4647 bp, Homo sapiens
  misc_feature (12)..(12): n is a, c, g, or t
aatgttgatccnctgccccgactatagaggatcccgtctgagcagctgggaatcacagctgcctcagccccgggcctgccaaggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447645 - DNA, 2762 bp, Homo sapiens
atccagccagaagcactggcttatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447646 - DNA, 8107 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtttaaagtccgggaggtgagagggacccagctgaagaggatggagtgagggcttccgtataactggagtacctggtgtcatgggaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447647 - DNA, 8218 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaatgcggtgaagcattgttgactctaatgtgtgaatccaaggcaattcgttggtaacaccaactatatcttaataatctttctaaggtttgaatcccaggctgctgtttccattcaacaaatgtttatgagcatctgttatgcaccaggccctgtgctgggtgctggagaaacaaggactttgctcctccagaaggagagaa

SEQ ID NO: 447648 - DNA, 7981 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagaagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447649 - DNA, 7909 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagttccacagtgcccgacaacctgcgagaaatctcgaatccagtgggctgctttccagttggaaacaggctagatcccaagaaacccatctccaaaagacctgttagtcccagcctg

SEQ ID NO: 447650 - DNA, 7872 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaacccccttccgagcggaccggtccgctcggaccatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgaca

SEQ ID NO: 447651 - DNA, 7778 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447652 - DNA, 7553 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagccgtggagctgcgggcggatgtacagtgtgcctgggggcttcccctctttcccagcccaggtccttacctcgtcgagtccttacc

SEQ ID NO: 447653 - DNA, 2815 bp, Homo sapiens
  misc_feature (752)..(752): n is a, c, g, or t
  misc_feature (754)..(754): n is a, c, g, or t
atccagccagaagcactggcttatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgntncccaacatgaggcctgtctcatcaccactctgcaaacccatgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447654 - DNA, 1374 bp, Homo sapiens
agaaaggaactgtctgccacaagcacgagatgacacactggttagaacatggagctctggcacctgcagcctaggctcaaatcctggctctgtcacccccagctctgagactctagggaagtggcttcaactctaccctggagccccctctaaagttgaaataatactgttgttacccagctcctgggattgctctgagagggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttacgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447655 - DNA, 881 bp, Homo sapiens
  misc_feature (13)..(13): n is a, c, g, or t
gtgtgcgtcgttntagaggatcccgtctgagcagctgggagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447656 - DNA, 6377 bp, Homo sapiens
  misc_feature (6343)..(6343): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcacncgcgagtagagcaccgcgagtagaggtaccgagc

SEQ ID NO: 447657 - DNA, 655 bp, Homo sapiens
agcggccgcctactactactaaattcgcggccgcgtcgactgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447658 - DNA, 6973 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagattcacatgtacctggccaaacgaacaactccatgttttccaaaaggcttggagaacataccaggtacctctcctctttccctttgtgtttgtcattttggcgaattactggaagatggtggttccagctgaaaggctttttggcaatttttaacagctgaaaataaaccttgaaataaacattttctcctttaactgatgtctgggaaggaagaaacaaaaaaagaaagagaagaaaggaaataaggaaggagggagggagagagtgaaggagggaagaaaagagaattaaacacgattatctacatatcaatggaaaatttcaaatatattctagcataatttttttctacttagtatccattaaaaaagggaatcattgtggaatgcttaaatcaatcaaatgaacacagccatccctcggatacttattttttttttttttttgtggtgagaacatttgaaattgattctcttagtagtttcgaaatgtgccatatgttaactatagtcactgtgctgtgtaatagatctcaaaaagtactcctctgcatcatatacatatatcataaccttgtattataccccataaatatgtataattataatctgtccgttaaaaataaaaattaagctttaaaaaaggggatatggtgctttctagaaaggaatagaagtgcctccatgtcacccagaggcccgcctgtgcagagactgcagctgtgctgcctccaggttgtgaggtgacccaagctgcccccatcacctcctgcctctttgctgcccccatcatccctcccagacccttccttctcctctgcccttgtcccctcagcagctctggtttgcagggggtatcaccatatagggctgtcctgggtgcaaacactgacttgctgcctgcctttcagctgtttggtcttgggcaagtcagtggccctctgtgaacctcacttttccctcctataaagtagggttaggacagttcatctcaatgaagtaccattagatggaaccagttaatctttacatgactttttaagcacttcttacctgctaaatagatagtagcactcattgctagtctatctggtcacagaggaaa

SEQ ID NO: 447659 - DNA, 3427 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447660 - DNA, 5216 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcagtgacacaagacttctcacactgtggaccccaaccgccatcttcgagggatccgtctagacga

SEQ ID NO: 447661 - DNA, 4900 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggccatcatctgtgggttgctgagctcacccagtacccagtgatcggggatacctctagaac

SEQ ID NO: 447662 - DNA, 4500 bp, Homo sapiens
  misc_feature (4430)..(4430): n is a, c, g, or t
  misc_feature (4457)..(4457): n is a, c, g, or t
  misc_feature (4479)..(4479): n is a, c, g, or t
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagtgacgcanaagtttgagaaggttccagaatcaaangtgatcttcgacgccaatgctnctgtggctgtcagatccaaag

SEQ ID NO: 447663 - DNA, 2851 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgtaagtgaagactgcagagttctcctcc

SEQ ID NO: 447664 - DNA, 2294 bp, Homo sapiens
catctcagtcgacttagagacccccctggttgttcatcagagggattgaagtgtatggaccgccagctgggaagccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatgttctacagttttattctctgactgacccaccaggacttcacccaatgcccca

SEQ ID NO: 447665 - DNA, 399 bp, Homo sapiens
agcggccgcctactactactaaattcgcggccgcgtcgacggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaa

SEQ ID NO: 447666 - DNA, 164 bp, Homo sapiens
ccctacacccttctgagtcagatttactaaatctgctttatttttagtgatgcagaagtttgagaaggttccagaatcaaaggtgatcttcgacgccaatgctcctgtggctgtcagatccaaagttcctgattctgagttccccgtgatgcagtgcttgacag

SEQ ID NO: 447667 - DNA, 576 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagccccagcctcgcgggctaagctgaccatgctcaacacggtggtccaaggaaagtccgacaggagcgtggacgcgatgcgggtgacagagaccccgggctacccgcagtcggaggggcttctgggacgacgtgcactgactcacgacgcgagcggggagggaagaacgcggaacgggaccatcggtg

SEQ ID NO: 447668 - DNA, 219 bp, Homo sapiens
gacaaataaaaggacaataagaaaaagaacattcccctccacctagaggtccagaaaacccaccagaaacaccacagggaatgataatgcactgacatgccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447669 - DNA, 170 bp, Homo sapiens
gcggccgcctactactactactgctcgaattcaagcttctaacgatgtacgggtcgtcagaagtacatgaggggcgcagagatgagcacacagctttgggcacggtccagggcaaactgaaatgtacgcctgaattttgtaaacagaagtattaaatgtctctttctaca

SEQ ID NO: 447670 - DNA, 2508 bp, Homo sapiens
agtattctatgttcgatgcggtgatataacttagccgaaggggtgccgcgatctgcagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447671 - DNA, 2438 bp, Homo sapiens
accggaagcgtgcggttgccatgtaatatcctggccgcgcgggcgcgcgagcggctgaggcggcgccggggcgggcgcggagctggcaagcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447672 - DNA, 2593 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacaaaaaaaagaaaaacaaaaaaaaaaaaaaaaaaaaaaaaaaaaaaaaaaaaaaa

SEQ ID NO: 447673 - DNA, 2631 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacaaaaaaaaaaaaaaacaaaaacaaaaaaaaaaaaaaaaaaaaaaaagaaaaacaaaaaaaaaaaaaaaaaaaaaaaaaaaaaaaaaaaaaaa

SEQ ID NO: 447674 - DNA, 2006 bp, Homo sapiens
tagcgtaggtcgatggccgtgtggttagctgtggcgcgatgaatcagctcatggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447675 - DNA, 1948 bp, Homo sapiens
  misc_feature (24)..(24): n is a, c, g, or t
tcaggctggtacggccccgcggtntgggatatcgtcgaccaggccgtcggtgcgagaaagactgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447676 - DNA, 2284 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatggagtaaatgcagggatcctctagaacacca

SEQ ID NO: 447677 - DNA, 2073 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatccccattaaattaatcccaacatgcaaa

SEQ ID NO: 447678 - DNA, 1415 bp, Homo sapiens
  misc_feature (25)..(25): n is a, c, g, or t
  misc_feature (38)..(38): n is a, c, g, or t
ccgaacctcagacgtaggctaggtncgaggctgggtgntgcgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447679 - DNA, 1726 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccactggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447680 - DNA, 1407 bp, Homo sapiens
agtattctatgttcgatgcggtgatataacttagccgaaggggtgccgcgatctgcagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447681 - DNA, 698 bp, Homo sapiens
agtattctatgttcgatgcggtgatataacttagccgaaggggtgccgcgatctgcagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgccggcaccccctgctgggtctcctgcattccacggagcccctgctgccagggcggtgtctgagcctgccggcgccactggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447682 - DNA, 300 bp, Homo sapiens
cctctgggtctcaggcaggcaggatccccagtggtgcagggacagtgggtcaaagccatgcgtggggcggccctctggccgctactggtgtgacccatgtcccccacgtctccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacgtgagtagctcggggtgtcacatcct

SEQ ID NO: 447683 - DNA, 435 bp, Homo sapiens
ggtctatatggtgaaaccccgtctctattaaaaatacaaaaattagctggatgtggtggcaggcccctgtaatcccccttactcaggaggctgagacaggagaattgcttgaacctgggaggcagaggttgcagtgagctgagatcatgccactgcactgcagcctgggcaacagcgagacttcatctcaaagaagttggaaaggatccaggtgtgggggtgaacgcctgtggtcccggctacttgggaggctgaggtgccagcatggcttgagcccagtttgaggcctgcagtgagctggtacagcgccactgcgttccagcctgtgaaacgctatttcaaaaacaaaggctgaggagtgtctcagtctagtggtcccaggcccggtatgatggcttcccccaccacttctccacaggtgacgcattgctggat

SEQ ID NO: 447684 - DNA, 532 bp, Homo sapiens
aagaggtggcagaaacactaagcagtggcacaaacgccctcacatgtaggcagcactttgtacatcgagcaggtgagtcagctctcggccctggtggatgcacagctggactaccaccggcaggccgtgcagatccctgcgaccggacggcatagtgactgcgcaaggcaaaaagggcccgtttcccaaataatgccgccaggatgcaggcgaacgcattacccgtcacagcccctcaagccgggagtataaagccccaaggcccccgtggggcaaagggccccccccttttattgcaccagtccaacgggggcttcccctgcaccacagcccccaagatcgcagcttcatcgtctttccgatcttccgacaagcccatccggacccctagccggagcatgccgcgccctggtaactcaaggtcaccggaaaagagccttttgggctaaaaatgtggggttctccagggggccccatttgggggtctttttttaaaaaacctcggggaaaaaccattttttccgggaaaggc

SEQ ID NO: 447685 - DNA, 2540 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447686 - DNA, 3026 bp, Homo sapiens
gggagggttggaaggggaagcattgccccggggtgggggtggggtaggtgtcaggagctcaacaggctctggaggcatctcagcaggacctgagctctccaactctaatggctttttaatgtgtgagctgaagtgtcagggggcggtctcttctggttctttttcgaagctgtccctggaaagcggatgaaagaatgtggtggccagggctgcagcgggtttccctctctcccttctctcccctcctctccctatctctcccccctcttcttcctctctttctgttctcactcttcccttgtctttctctctgtctctcccttcttttgccctctcacctcttcttcctctctctctgtctgtcctctccacaccttcttcctgtctgtctgcctgcctgtctctctctttctctatctctcgccttttgcagggctggatttggcaagcacttttcctgagcactgcagcttggtgcgtttctgctcatttcctgttaagcagtacccagggctccctgaactcaggctctgggaggacggccctgtcttccttttcctctccactcctagaaaaacctgctgaccaggccctgagagcagggtcacggggagacctcctcaccacagcaggaagatagacggacagtttcctccattggacctgactcagcagcggcccactgaccgcctgggagggggctcccgcctagcgggccgcagttccacacctggctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447687 - DNA, 2771 bp, Homo sapiens
atctgggcttcttttttaggggggagctagatccaccataaacattttatgtgtatatgtacaccgtttatcatatacatattgtgacaactgtatatatatatatatattttgagacagagtcttgctctgtcacccaggctggagtgcagtggcgcaatcttggcttactgagaccaacctccgcctcccgggttcaagcgattctcttgcctcagcctcctgagtagctgggattacaggtgcgccaccacacccggctaattttttttgtatttttagtagagacagggtttcaccatgttggtcaggctggtgttgaactcctgacctcatgatctgcccgcctcagcctcccaaagtgctgggattacaggtgtgagccaccgtgcctggcctaaacaacttgtatgtatacatacactgtttatcatatatacgtattgtggcaaccatatgtatgaataagccttcaaaagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447688 - DNA, 2615 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacaaaaaaaaaaaataaagaaaaagaaaaaaagaaaaacaaaaaaaaaaaaaaaaaaaaaaaaaaaaaaaaaaaaaaa

SEQ ID NO: 447689 - DNA, 2592 bp, Homo sapiens
gtaatcccaacactttgggaggccgaggcgggcggatcacaaggtcaggagttcgagaccggtgtggtctatatggtgaaaccccgtctctattaaaaatacaaaaattagctggatgtggtggcaggcccctgtaatcccccttactcaggaggctgagacaggagaattgcttgaacctgggaggcagaggttgcagtgagctgagatcatgccactgcactgcagcctgggcaacagcgagacttcatctcaaagaagttggaaaggatccaggtgtgggggtgaacgcctgtggtcccggctacttgggaggctgaggtgccagcatggcttgagcccagtttgaggcctgcagtgagctggtacagcgccactgcgttccagcctgtgaaacgctatttcaaaaacaaaggctgaggagtgtctcagtctagtggtcccaggcccggtatgatggcttcccccaccacttctccacaggtgacgcattgctggatgccggcgagtccatgaagcgcctggcagaggtgaaggactccctggacatcgaggtcaagcagaacttcattgaccccctccagaacctccagcctcggcactgccctctgggtctcaggcaggcaggatccccagtggtgcagggacagtgggtcaaagccatgcgtggggcggccctctggccgctactggtgtgacccatgtcccccacgtctccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447690 - DNA, 2306 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447691 - DNA, 1538 bp, Homo sapiens
  misc_feature (28)..(28): n is a, c, g, or t
  misc_feature (42)..(43): n is a, c, g, or t
  misc_feature (45)..(46): n is a, c, g, or t
agaaagagcaaaagctatgggctaggtncgaggctgggtgtnncnngatcgcagcttcatcgtctttccgatcttccgacaagcccatccggacccctagccggagcatgccgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447692 - DNA, 1912 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaaccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctaca

SEQ ID NO: 447693 - DNA, 1230 bp, Homo sapiens
accggaagcgtgcggttgccatgtaatatcctggccgcgcgggcgcgcgagcggctgaggcggcgccggggcgggcgcggagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccagctggtcagtgagaaggtcggaggggccgaggggaccaagctggatgatgacttcaaagagatggagaagaaggtggatgtcaccagcaaggcggtgacagaagtgctggccaggaccatcgagtacctgcagcccaacccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgacgcattgctggatgccggcgagtccatgaagcgcctggcagaggtgaaggactccctggacatcgaggtcaagcagaacttcattgaccccctccagaacctgtgcgagaaagacctgaaggagatccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacatcgagcaggtgagtcagctctcggccctggtggatgcacagctggactaccaccggcaggccgtgcagatcctggacgagctggcggagaagctcaagcgcaggatgcgggaagcttcctcacgccctaagcgggagtataagcccaagccccgggagccctttgaccttggagagcctgagcagtccaacgggggcttcccctgcaccacagcccccaagatcgcagcttcatcgtctttccgatcttccgacaagcccatccggacccctagccggagcatgctcgtcagaagtacatgaggggcgcagagatgagcacacagctttgggcacggtccagggcaaactgaaatgtacgcctgaattttgtaaacagaagtattaaatgtctctttctaca

SEQ ID NO: 447694 - DNA, 487 bp, Homo sapiens
gatgataccactcacctcaaatagatgttctaagaataatatgaaattgacatgtgttaaacctgcctaacaaacccggcaccgtactaaatgttagctgaaatggaatgtaagataacctagtgctttacaaaatgtgtaccttatagcaagtgcttagtattaaatgaatgaatgatgcttttcagttgctattactctgtgatccttaagccatacggccttactacatccagttttttaactgtggaaagacaagaaccttttaccttcagaagtgcttcaggattcgtaaaacatgttaagtatcctgacactacaacttcaagaattatacatttataatatcccaccaataaacatctaaccataaacacttcagcagcatctaatagccacctatctgcctaaatgatttacacatcattagaaaggtattctggaaatgaagaaggcagggcaaaaagtttgcatacacagaaaacac

SEQ ID NO: 447695 - DNA, 3155 bp, Homo sapiens
atgggtagccgggcgcggggcggggccgcggggccgccgcttaaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccggggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgg

SEQ ID NO: 447696 - DNA, 4538 bp, Homo sapiens
atgggtagccgggcgcggggcggggccgcggggccgccgcttaaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggccacacgcaggctccgggctctgcaccccgggcgggtgtcagggcgggtcccagtggaaaaacatcctctggccagccggggtccggcgccagctatgggagtcgggatccgcggagggcagcgcctggggtgtgcaccctcgtggcgggtgcgctctggagccagttctcctggcggggaacaccctgcggagggccatggctggcaccccgacgtgccctccagccgttgcgagtggccccagccccgggaggcacgcccggcacgacagcaagttgcatgcggctctctggaggtgctccctccttagaaagggctcagctcctctagctcctggaccacccatggggagggagtgcggcaggcggatgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggttctcttggtttggggctctggttcccgtatcctgctcctcacctggaagaagggagcttggagcttgcgtatttgcacctcctgccttctgtctggatctagggcgcagccacggggcgctgtggacggcaggcccctgctcccccaagtcctgccgcacaggcggttggaggtgagcctcgggaagagtcccaaggagtgtgtcctgtggctcagtgaggacgggcgcctgggccctgccagggcttctgggtgtctgggaatggagggacagcagcccagctgcccgccgaaggccggcaccgttcccgggaagcctcgcttttgtccaccgccggctgggtcctgcccgcctcccccgcctcccttagaaagccccagagggagggaacagcaggcccggaatagggggaaatagaaggaggaagatgggaggcgtggggcttgttcttctttggctgtcgtaagcataccaaccttcccaaacaggcgccggccggttctcccagaggagtgtactgcctggtgccacgggaggctccggagcgcacggcaggcgggtttccctggtcagagcctcctggccccggcctctgctgccggttccccctgtggtgtgtgcctgcgccgagggcacagtgggcgccctggccatccctgcctctgccctgtgctgcagcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccggggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgg

SEQ ID NO: 447697 - DNA, 4371 bp, Homo sapiens
  misc_feature (31)..(31): n is a, c, g, or t
cccctgctgctctcaagtttcccgttggcgncgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcggggcctggccgggccctggccccggcgggcctcagtgccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447698 - DNA, 3799 bp, Homo sapiens
ttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaata

SEQ ID NO: 447699 - DNA, 4104 bp, Homo sapiens
tgtcagcttgctgcctgctgcggactattctagaggccccgggacgagcgcagggctcagaagtgggagctactcatctaccacctatgtacgacactgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447700 - DNA, 4530 bp, Homo sapiens
  misc_feature (31)..(31): n is a, c, g, or t
cccctgctgctctcaagtttcccgttggcgncgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcggggcctggccgggccctggccccggcgggcctcagtgccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacagggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447701 - DNA, 4400 bp, Homo sapiens
  misc_feature (31)..(31): n is a, c, g, or t
cccctgctgctctcaagtttcccgttggcgncgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcggggcctggccgggccctggccccggcgggcctcagtgccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacagggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447702 - DNA, 2591 bp, Homo sapiens
acgcattttgcacccgaggctgtgggagatgcagtgatggagtcttgctctgtcacccaggctggtgcgatctcggctcactgcaacctccacctccggggttcaagtgattcttctgccttagcctcctgagtagctgagattacaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447703 - DNA, 2293 bp, Homo sapiens
gactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447704 - DNA, 815 bp, Homo sapiens
ttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgc

SEQ ID NO: 447705 - DNA, 190 bp, Homo sapiens
cagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatg

SEQ ID NO: 447706 - DNA, 384 bp, Homo sapiens
tgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccct

SEQ ID NO: 447707 - DNA, 4313 bp, Homo sapiens
gagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcccgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447708 - DNA, 4258 bp, Homo sapiens
ttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447709 - DNA, 4076 bp, Homo sapiens
ggttgaggccagtgactgttagtaaggaatcagtatgcgaggaggtggatagagaaagcttctttgagggactgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447710 - DNA, 3468 bp, Homo sapiens
acctgctctgcgaacatctacggccagtgccagaaccagtgtcagaaggccttgcatacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447711 - DNA, 2974 bp, Homo sapiens
caggcggctggccagggtggagcccatggctccaggatgggctggggtatgtggttagggaaacagagctgagtaacagaatgtttgggtcactgggaatttgaggattcatatctcagtctcttggacagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgaccggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtgggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccgggtgcatttttttaaggcaaaatttctcccttatctactgtgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccatttatatacatttgccctaacataggaagtattgtgtagtttctcattgtcattttatctgtatcaagtatctttttttaaattgttaaataaagtcagctaggactgtgg

SEQ ID NO: 447712 - DNA, 1752 bp, Homo sapiens
  misc_feature (31)..(31): n is a, c, g, or t
cccctgctgctctcaagtttcccgttggcgncgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcggggcctggccgggccctggccccggcgggcctcagtgccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttagga

SEQ ID NO: 447713 - DNA, 2221 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447714 - DNA, 1409 bp, Homo sapiens
caggattaagcatgtatttattttagttcagttaaaacaaacatacattgtttcattgaaacggtgtagcactctttgccaacaagccatactagaattgttggcctctaacagtacagtggggatatttacactatatacacaaagttaatacacccaggttctcaaaggtcttccattacactagatcacattttatttcattacactagatcacattttgattactgcattttgaaaatgtattccttatttaaattttaaataagagatctgaatttgtaccaagatttcatgaaaaaatttgatgttgtttattgcaaatacaatttaaacaagttttttttagtgtttgtacacaatttgtcaatttttcaatattcaattttctgtacaggtacttttgggacaattcttatagttacataatgtgaattcatcaaaatgcagttaagaaacttacaggaatatatacacttgaacccaagacccaaacctgacattatatacaacctatttacaaatacatatggacagacaatatatgtacatagattatcataaatattgaaaaataggttagctttaatggattaatgttgttctataaataacattacagttgtaactgaaacatccacggaagacagtaatgcaaaatgaggtgacaagacagtggttttaatactgaagactgctcattaatgggaattcattgttcaggaacctcaaggtagacaagatagctcccagaaaatcatccattggaattttccctaggcacttgattttgaaccttaaatagccagaggattggaggagcttcctcacattaatttgctgtagagaaaagattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447715 - DNA, 686 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcaggtaccgtcgttcgcggcagggctgcggccgggtcgggacgagagggagggagggatccgccccagccgggaagccccgccccgcttctccgaggtcgccctagcccgggacccctgcgtcgggccctgagcgggcgacggggacgcgaggtggggtcgcgagactggggctccgtggtttgaactcgtcggttgcctttctcctgcctcttccctggttgccgccacaacaaatcacgccgcttgtttttccgactcttgtaatccacttttaaatacgattatgcgctgcagaaggacgttgctggtcaatgtgggacagcgtggtctcaaagattataatatcgtcttcttactgtacctttttttatggttagatacgcagatactcactagt

SEQ ID NO: 447716 - DNA, 726 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatgggtgagtgtcactcttttatttatcctttttattccatttttgtttaggtccttggaaattccacaactgtgttctttcatcagccttcccacgtggcaaaacattctaaactgcttatagaggtccaaaagtactaaagatgcaaattctttgccaaatatttcttgcctcttatttcctcttccttatcagtattgaaatagagaagtatcactaaacttctgagattagcatgacaaataaagctaatagttactatgtcatcttcctgtagtgtatttttagtagaacaatataaatttcaaaaaacttttttgacaa

SEQ ID NO: 447717 - DNA, 497 bp, Homo sapiens
tccttcagtgttctttaaaactctggccctattcactaatttgtaaatctattcaagaatggcactaagactttttgatagataatagcagtattccatcttaattgtaacttgtgatttctgccttttttaaggttctctttggattccagttgttgctgctttactactctttctagtgcttagcctggtattcatctgtttttatattaagaaaattaatccattgaaggaaaaaagcataatattacccaagtccttggtaatgtatttaatttttttatatacactaaaaagttaacttgaaccttttttgatagtttcttaaattatgtttttaaagtagaatgatattcaacaagatgtcacctgccatcaatcagtcagtctaccacacatgcaaaatcacatactgtgtcttttgctgtgcagcaagtattttgtttttttttttattctcagggaaaaacacggtgagacaattctgttaaagatct

SEQ ID NO: 447718 - DNA, 413 bp, Homo sapiens
cttacattttgaattgagcctctttactgtaacagagtttgtagttcttctaactaaagagtaagggtttcctactttctctggcgtctccatcctattcttagctctgctctttctaccgctttgtgctgtgaataaaaagcaaagcacagacagaaatggtttgagtttatttaataacaataaaagttatcttcgcatttttttattctttttagtgttaagaattcagaatggattgatgcctgcatcaatatttctcatcattattgtaatatttctgatcatgttggtgatccatcaaattctctttgggtcagagttgccttcggtcaatccacaagccacggtcaatccacaagccacggtcaaaccacaagccacggtcaacccacaagccacggtcaacccac

SEQ ID NO: 447719 - DNA, 2332 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtggccataatataattgtgataatgtaataaaatcaggaaacattacctgaagcagatgcttttgaagtcaccagaaaatagtcttctccaattccaatttaaatatggagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447720 - DNA, 2220 bp, Homo sapiens
  misc_feature (1674)..(1674): n is a, c, g, or t
  misc_feature (1676)..(1676): n is a, c, g, or t
  misc_feature (1679)..(1680): n is a, c, g, or t
  misc_feature (1686)..(1686): n is a, c, g, or t
  misc_feature (1693)..(1694): n is a, c, g, or t
  misc_feature (1699)..(1700): n is a, c, g, or t
  misc_feature (1707)..(1707): n is a, c, g, or t
  misc_feature (1716)..(1717): n is a, c, g, or t
  misc_feature (1720)..(1720): n is a, c, g, or t
  misc_feature (1727)..(1727): n is a, c, g, or t
  misc_feature (1738)..(1738): n is a, c, g, or t
  misc_feature (1740)..(1740): n is a, c, g, or t
  misc_feature (1742)..(1742): n is a, c, g, or t
  misc_feature (1744)..(1744): n is a, c, g, or t
  misc_feature (1751)..(1751): n is a, c, g, or t
  misc_feature (1758)..(1759): n is a, c, g, or t
  misc_feature (1764)..(1764): n is a, c, g, or t
  misc_feature (1766)..(1766): n is a, c, g, or t
  misc_feature (1775)..(1775): n is a, c, g, or t
  misc_feature (1778)..(1778): n is a, c, g, or t
  misc_feature (1781)..(1781): n is a, c, g, or t
  misc_feature (1785)..(1785): n is a, c, g, or t
  misc_feature (1794)..(1794): n is a, c, g, or t
  misc_feature (1799)..(1799): n is a, c, g, or t
  misc_feature (1814)..(1814): n is a, c, g, or t
  misc_feature (1832)..(1832): n is a, c, g, or t
  misc_feature (1838)..(1838): n is a, c, g, or t
  misc_feature (1842)..(1842): n is a, c, g, or t
  misc_feature (1855)..(1855): n is a, c, g, or t
  misc_feature (1863)..(1863): n is a, c, g, or t
  misc_feature (1865)..(1865): n is a, c, g, or t
  misc_feature (1873)..(1873): n is a, c, g, or t
  misc_feature (1877)..(1877): n is a, c, g, or t
  misc_feature (1880)..(1881): n is a, c, g, or t
  misc_feature (1886)..(1886): n is a, c, g, or t
  misc_feature (1891)..(1891): n is a, c, g, or t
  misc_feature (1903)..(1903): n is a, c, g, or t
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagacccccaccngnccnncccagncgccccnnccccnnacccccncccccccgnnccnccccccnccccaaccccncnanangaccacnacccccnnaaccncnccccagccngcnccncccnaatggagtnacccngtgcacacgaaagcncaaagaggacgcgcggcncccccncctntggcctgcaaagnacagaccncngctctccnccanacnngaaangcagngcgacccacganccctcacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447721 - DNA, 1128 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgaggtatgtgtttcacatttttcataatggaaattcttgtgtagctagcaaaagttgttcctttctgtagtgtaatgaaaataggatgcttataaatattcaagcaagactcacagatcatagatttgataagaaaaatatgtgaatgctattaaagcaaaaatgatacagagttagtcactaacactgaccatgtgaatacatttagtttttatttgcttcatttagcagaatggctctaatctaggatttttcccagtacacctccattgctccactggtaaaatgaggattttcttcctcattggcggtgacgtaaagtaatattaatacttctgtttcccaccagctaaatttctggacaaatgaataggacaaat

SEQ ID NO: 447722 - DNA, 1064 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggtaagttcttgccattttttttctaaatatagagggagcagtaactaaaataggatcatgtgaggaaagcaaactcatttgcagtttcaaaagatctgttttaacaatattcatttgcattagttccattccttagagaagttcaaaattaaaaataaagcagtttctcacacatttaaagatatagaacaactaatttggaaagccatgtgatggccccttgacccagg

SEQ ID NO: 447723 - DNA, 2167 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaaggttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447724 - DNA, 1738 bp, Homo sapiens
cacaataggccatctgcaggctgaggagcaaggagagccagtccaagctccaaacttgaagaattcagagtccgatgttcaagggcaggaagcattcagcatgggagaaagatgtaggctgggaggctaggccagtctctcttttcacatttttctgcctgcttacattctagccatgctggcagctgattagattgtgcccattcgggttaagggcgggtcttcctttcccagcccactgactcaaatgttaatctcctttggcagcaccctcacagacacacccaggatcaatactttgtatccttcagtccaatcaagttgacactcagtattaaccatcacagtaacgtacaaaaagcaacatatattagtaagatatctgatggctttttaaaaattctaaaactttgtttttaatattactatgggacctttcattaaaaagaaatggcaacatctgattcacccattatcctaaatgtgccatttggtggtccattacttcagacctttgttttttttgagggtaggcacttaagcttaacaattttttatctttaatcaatttttctccccatagatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 447725 - DNA, 1168 bp, Homo sapiens
gacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagcgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggtaagttcttgccattttttttctaaatatagagggagcagtaactaaaataggatcatgtgaggaaagcaaactcatttgcagtttcaaaagatctgttttaacaatattcatttgcattagttccattccttagagaagttcaaaattaaaaataaagcagtttctcacacatttaaagatatagaacaactaatttggaaagccatgtgatggccccttgacccagg

SEQ ID NO: 447726 - DNA, 498 bp, Homo sapiens
catcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggcaagtaaccatatgtccttcttt

SEQ ID NO: 447727 - DNA, 2621 bp, Homo sapiens
catcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgca

SEQ ID NO: 447728 - DNA, 3419 bp, Homo sapiens
ttcagctatatgaagtgttaacccagtaattgggcgaagccagtgaccaactaatgagattctggtactgaatgtaatagagaattctattctcggcttgaataaacaattaacttcccatgtgtgctagaaccaatgggccaattgaactcggaataagcatccaattcagcctttagatattgagaggccttgagacatctcagacattgtgagaacgcaaatgagcacaccaccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattgaaaaaaaaa

SEQ ID NO: 447729 - DNA, 3077 bp, Homo sapiens
atggatggtgaatgagatagggaagactgagaaaagaacaggatagagacatgattttattttatagtgacaaagaggctaaaaacaactgagagaacttcagtatatttagttgtagttgctttgtgagtcagggcagttgcatttggaattccctcccagattatgttttccaaagggaaatcaaacccaattaataaatctgtgtctccatttcaggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattgaaaaaaaaa

SEQ ID NO: 447730 - DNA, 1519 bp, Homo sapiens
catcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtccctttttatcatccttaaaacaatgatgcaaaagggctttagagcacaatggatct

SEQ ID NO: 447731 - DNA, 3332 bp, Homo sapiens
catcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattgaaaaaaaaa

SEQ ID NO: 447732 - DNA, 3595 bp, Homo sapiens
catcttcaggcctggactacaccactcaccctcccagtgtgcttgagaaacaaactgcacccactgaactccgcagctagcatccaaatcagcccttgagatttgaggccttggagactcagatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattgaaaaaaaaa

SEQ ID NO: 447733 - DNA, 2983 bp, Homo sapiens
tctcccaaggatgaagaggtctcctaggcatgatgccacaccaactaaggctgaatacaatttaatttgagactcattacttattctttcctatacagaattgattcttcaactgattattcataccttactttctatcagcaatacacattaaccatctgttgtgtgccaaaagttgtgttaagagttagggttataaagatgctgtctcctgtactagcagttctcacagctattcattacttgtctaaagaattgatctcttaatcgttcaattatagtcaacaataacttactgaacaccaacaatgttctttgtgccattattacattttcaccttcattcttctgttgtttttcagggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattgaaaaaaaaa

SEQ ID NO: 447734 - DNA, 574 bp, Homo sapiens
  misc_feature (1)..(2): n is a, c, g, or t
nntttttttgtagagatggagtctcagtatgtttcccagtctggtcccgaactgtgctggcctcaagccatcctccccccttagcctcccaaagtgctgggattataggtgtgagcctctggacccagccccagtatcatgctattccaaacaatgctacctcaaaatattttgcacttatatgtaaatatatacaatcatataattacacgtgggttcatatctctgtagaatatggacttcagtgtggaatttctgggtcaaatgggatgcatactaaatatttttctagatcatagcaaattatcttctcaaaaggctgtatcattttatattcccaccaacatacttgtttactctttcttgccaacattggatattatctctaatattttacaagtctgtaaagtgatgttagtataccaaatgagcaaaattaacaacatttgaagttatttttagcttatccaatcttgctcatactcacttgctcaagaagaaaagttatgtgcaagccattctgcaactactacctccccttttaattaagaaatgtcttccaaacttttgcctt

SEQ ID NO: 447735 - DNA, 4138 bp, Homo sapiens
  misc_feature (1112)..(1112): n is a, c, g, or t
  misc_feature (1114)..(1115): n is a, c, g, or t
  misc_feature (1121)..(1121): n is a, c, g, or t
cccactatgttggccaggatggtcttgatttcttgacctcgtgttctgcccgcctctacctcccaaagtgccgggattacaggcgtgactgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttggctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcactttttggacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatgggggggtgattgaggaacaagatgtctctaagatgagaagttattttcttgcatcatagaagcactctntnnacccgngagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccggaattcttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccaccttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgcctt

SEQ ID NO: 447736 - DNA, 3965 bp, Homo sapiens
ggctcggggacctgtcaggctggtttcgacagctggggaattaacctgtcccgcccatccctagcctcgagccgcgcaggctccgcgcctccgcccttgttccctcccagctcctccgagtggaagccgctacaaatggcttgaatgaaacgtgtgtgggtttagtgagtggtgaaccaccagggatcccgtctccccacaaaccagtatctctccgaggaggaggcgaaggagtgggaggaggcaacgagccgagagtcgagcttcgcgggcgcgcgcagcggctggagcgcgggggcgaggccgggccacctccccttcccggccgcgcactgcctggcccgcggcggttccaggcaccacccttcccgtccgggctgagcccgctgtggcagtgactagctcccgcggctagcggcactgtccaccgacgagcggcgccctcttctcccccttctccccacgatttccttctctgcggcggcacgccgtccagcagcctgcttcgccccgtcgtcaactttgagctggaggagaagcaactttggcagtggccgcggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccaccttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaagatacaattactggttctatgcacaatttaaaaccggccttactgttttataacgtattttcttttaaggcaggtaatcattatgttataaagaagtttttctaatagcagtattttatatgcatgattcataaaactatgttgtatgttaaaacaaagctgtatttttaatattcaggtatagatgtcaaattacttctgaatacttataaaatatgaataaatagcagagtaggaagaaagtttcttttttaaaaaattcacctctgaactagcacatagagctacagattttcccttggggaattatgggcagaatcaagaattttaaaatgcagttgtcatctgatttcctctgaacactgacctttgaagctttgtgaatcctacgttaagcactctgagttctaatttttctccttttgaaaaataaacttgatgaaatct

SEQ ID NO: 447737 - DNA, 4019 bp, Homo sapiens
ggctcggggacctgtcaggctggtttcgacagctggggaattaacctgtcccgcccatccctagcctcgagccgcgcaggctccgcgcctccgcccttgttccctcccagctcctccgagtggaagccgctacaaatggcttgaatgaaacgtgtgtgggtttagtgagtggtgaaccaccagggatcccgtctccccacaaaccagtatctctccgaggaggaggcgaaggagtgggaggaggcaacgagccgagagtcgagcttcgcgggcgcgcgcagcggctggagcgcgggggcgaggccgggccacctccccttcccggccgcgcactgcctggcccgcggcggttccaggcaccacccttcccgtccgggctgagcccgctgtggcagtgactagctcccgcggctagcggcactgtccaccgacgagcggcgccctcttctcccccttctccccacgatttccttctctgcggcggcacgccgtccagcagcctgcttcgccccgtcgtcaactttgagctggaggagaagcaactttggcagtggccgcggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtcgcttctctgggagtcaccaccttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtaccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattgattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaagatacaattactggttctatgcacaatttaaaaccggccttactgttttataacgtattttcttttaaggcaggtaatcattatgttataaagaagtttttctaatagcagtattttatatgcatgattcataaaactatgttgtatgttaaaacaaagctgtatttttaatattcaggtatagatgtcaaattacttctgaatacttataaaatatgaataaatagcagagtaggaagaaagtttcttttttaaaaaattcacctctgaactagcacatagagctacagattttcccttggggaattatgggcagaatcaagaattttaaaatgcagttgtcatctgatttcctctgaacactgacctttgaagctttgtgaatcctacgttaagcactctgagttctaatttttctccttttgaaaaataaacttgatgaaatct

SEQ ID NO: 447738 - DNA, 807 bp, Homo sapiens
agcccagttacccatgcctcattctggaaaactgttctctctctctctctcatttttatttatccatatttttttttacagttttgccaatctgcatttatttcctagtgctttgatctttcgggggacaccgggaataaatgtcttctatgttcccccacaggtcgcttctctgggagtcaccaccttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattttgcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaaccctt

SEQ ID NO: 447739 - DNA, 2829 bp, Homo sapiens
caggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaaggtcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatcagggccctagaaagtgctaggaggaaggggttaaaaaaaaaatttgtccgcgttgcaaactattataaatgattgccacattgcaagctattattttctcccaccatattttttaattaaaa

SEQ ID NO: 447740 - DNA, 2407 bp, Homo sapiens
  misc_feature (11)..(11): n is a, c, g, or t
  misc_feature (24)..(24): n is a, c, g, or t
  misc_feature (43)..(43): n is a, c, g, or t
  misc_feature (45)..(45): n is a, c, g, or t
gctcagagganagttggccaaggnaacaagagcatcctggatngnaccctgaggcccagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaaggtcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatcagggccctagaaagtgctaggaggaaggggttaaaaaaaaaatttgtccgcgttgcaaactattataaatgattgccacattgcaagctattattttctcccaccatattttttaattaaaa

SEQ ID NO: 447741 - DNA, 2772 bp, Homo sapiens
caggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaaggtcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatcagggccctagaaagtgctaggaggaaggggttaaaaaaaaaatttgtccgcgttgcaaactattataaatgattgccacattgcaagctattattttctcccaccatattttttaattaaaa

SEQ ID NO: 447742 - DNA, 2468 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagccaacaaaaggaaaataaatgaacatatgtttgcttatatgttaaattgaataaaatactctctttttttttaaggtg

SEQ ID NO: 447743 - DNA, 3455 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagccaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaattttgagtgcaggtgaccaaaaatattgctgaggagtggcacgtttgacatgagtaaaatgtcttaacttcggatttttagcgggaaaatgttataaattggagtttcttttaaatagctttttttaaaatacattaaggatgtctcgctcatgtagaagtcaaattttgttgcaaacgcattgctcccttcacacccaatctctcccctgcaaaaaatcttcacagaattctgtgagaacttttaggtgtgtttttctttgagatacctctggttgccaaacaccaggtaatagattttttaaagttgttattagattattcttacctctcatgatgcatattttagcaatcaccttatcattgtgtctcatgttctgtcctccttatattctttgcccagcaagattctacttatgatgaatgaatgctcttctccttttttcattcaatggtatgaagtatttgttagggttctttagtacttacacttgttgtgtagaaaatgact

SEQ ID NO: 447744 - DNA, 2884 bp, Homo sapiens
aatttcaagaaaaggggaaggcctgcggcctcaaacccgtaaatctcagcgcaggtcaagctttccacctgcccctcactggacagaccttatcaggtagcacgtaccttaattgtgtgtttttctggttctttgtcattctcgtcgtccactcccgggagtggagagagaacgttccacttacaacacacaactgttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagccaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaattttgagtgcaggtgaccaaaaatattgctgaggagtggcacgtttgacatgagtaaaatgtcttaacttcggatttttagcgggaaaatgttataaattggagtttcttttaaatagctttttttaaaatacattaaggatgtctcgctcatgtagaagtcaaattttgttgcaaacgcattgctcccttcacacccaatctctcccctgcaaaaaatcttcacagaattctgtgagaacttttaggtgtgtttttctttgagatacctctggttgccaaacaccaggtaatagattttttaaagttgttattagattattcttacctctcatgatgcatattttagcaatcaccttatcattgtgtctcatgttctgtcctccttatattctttgcccagcaagattctacttatgatgaatgaatgctcttctccttttttcattcaatggtatgaagtatttgttagggttctttagtacttacacttgttgtgtagaaaatgact

SEQ ID NO: 447745 - DNA, 4158 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggagaatttgcagccttcaagtagccaccatcatggcagcatctgctcttatttcttaagccttgtgttcgtacaatttgttaacatcaaaacacagttctgttcctcaaatctttttttaaagatacaaaatttccaatgcataagctgatgtggaacagaatggaatttcccatccaacaaaagaggaaagaatgttttaggaaccagaattctctgctgccagtgtttcttcaacaaaaataccacgagcatacaagtctgcccagtcccaggaagaaagaggagagaccctgaattctgaccttttgatggtcaggcatgatggaaagaaactgctgctacagcttgggagatttgctatggaaagtctgccagtcaactttgcccttctaaccaccagatcaatttgtggctgatcatctgatggggcagtttcaatcaccaagcatcgttctctttcctgttctggaattttgttttggagctctttcccctagtgaccaccagttagtttctgagggatggaacaaaaatgcagcttgccctttctatgtggtgcgtgttcaggccttgacagattttatcaaaaggaaactattttatttaaatggaggctgagtggtgagtagatgtgtcttggtatggaggaaaagggcatgctgcatcttcttcctgacctccggggtctctggccttttgtttccttgctcactgaggggtctgtctaaccaagcaggctagatagtgctggcacacattgccttctttctcattgggtccagcaatgaagataagtgtttgggttttttttttttcctccacaatgtagcaaattctcaggaaatacagtttatatcttcctcctatgctcttccagtcaccaactacttatgcggctactttgtccagggcacaaaatgccgtggcagtatctaactaaacccccacaaaactgcttaataacagttttgaatgtgagaaatttagataatttaaatataaggtacaggttttaatttctgagtttcttcttttctatttttattaaaaagaaaataattttcagatttaattgaattggaaaaaaacaatacttcccaccagaattatatatcctgaaaattgtatttttgttatataaacaacttttaagaaagatcattatccttttctctacctaaatatgaggagtcttagcataatgacaaatatttataatttttcaattaatggtacttgctggatccacactaacatctttgctaataatctcattgtttcttccaactgattcctaacactatatcccacatcttctttctagtcttttatctagaatatgcaacctaaaataaaaatggtggcgtctccattcattctccttcttccttttttcccaagcctggtcttcaaaaggttgggcaatttggcagctgaattcccagacagagaatagagcaattttagggatattaggactgagggagggtgtgggaaagctgtcatcagttgtttttatagaaagaactggcattcattaagaacctaaatcttatctttgcacaaatggaaaatataacctagttatagcttcctttggcctttattaaagggtaatatcaatcacagtcatagcaaagaaagcggatgtattaatggcaaattaatggaaaacctcccttatcaggaatctagactcagaatttaggaacacaaatcaaatcagaccaaccaagctatagccaaggacttgaaagaaattaaacaagacccagaataaatcaaggaattagaaattgttatttaaaaatttcaga

SEQ ID NO: 447746 - DNA, 2153 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccaggcttccccatccccgtacgttcgtataatcgacgaccagctccgagctacatgccatcagcatcgactctagagcatacagccagtcagaactggatctcgac

SEQ ID NO: 447747 - DNA, 408 bp, Homo sapiens
gtcttatcattgatagttcctggagggcctacttgagcaaagcagctttggcagtattggatttttaaattaatacttttaaaagtcattactgctaggtttttaatgctttaatgattttgagaatataaaaacaagaaaatccttttatcttcctttttaaatattattacctttatatcgttactctgaatcttatcttccaatgacttcatttttccaggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgtaagtatccagcattgctagaact

SEQ ID NO: 447748 - DNA, 280 bp, Homo sapiens
ttcatttttccaggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgtaagtatccagcattgctagaactaaaaaaaaaccaagtatgtatctttatttttctgctataattataacttagatcagaaataagtgccatttttcatttatca

SEQ ID NO: 447749 - DNA, 721 bp, Homo sapiens
ctgaagcactgggccaaattctcaccagtccgtctcttcaaaatccattccaattccacagcccttccgaccagcagatgaagatcatcgaaatcaatttgggtaacgagaccgatcctcatcagctcccaatgtgcatatgaacacaatagaacctgtcaatattgatgtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggcccaaattctcaccagtcgtctcctcaaatcattcattcccagccttcgacagaaataaatatgaatcattggca

SEQ ID NO: 447750 - DNA, 3713 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggagaatttgcagccttcaagtagccaccatcatggcagcatctgctcttatttcttaagccttgtgttcgtacaatttgttaacatcaaaacacagttctgttcctcaaatctttttttaaagatacaaaatttccaatgcataagctgatgtggaacagaatggaatttcccatccaacaaaagaggaaagaatgttttaggaaccagaattctctgctgccagtgtttcttcaacaaaaataccacgagcatacaagtctgcccagtcccaggaagaaagaggagagaccctgaattctgaccttttgatggtcaggcatgatggaaagaaactgctgctacagcttgggagatttgctatggaaagtctgccagtcaactttgcccttctaaccaccagatcaatttgtggctgatcatctgatggggcagtttcaatcaccaagcatcgttctctttcctgttctggaattttgttttggagctctttcccctagtgaccaccagttagtttctgagggatggaacaaaaatgcagcttgccctttctatgtggtgcgtgttcaggccttgacagattttatcaaaaggaaactattttatttaaatggaggctgagtggtgagtagatgtgtcttggtatggaggaaaagggcatgctgcatcttcttcctgacctccggggtctctggccttttgtttccttgctcactgaggggtctgtctaaccaagcaggctagatagtgctggcacacattgccttctttctcattgggtccagcaatgaagataagtgtttgggttttttttttttcctccacaatgtagcaaattctcaggaaatacagtttatatcttcctcctatgctcttccagtcaccaactacttatgcggctactttgtccagggcacaaaatgccgtggcagtatctaactaaacccccacaaaactgcttaataacagttttgaatgtgagaaatttagataatttaaatataaggtacaggttttaatttctgagtttcttcttttctatttttattaaaaagaaaataattttcagatttaattgaattggaaaaaaacaatacttcccaccagaattatatatcctgaaaattgtatttttgttatataaacaacttttaagaaagatcattatccttttctctacctaaatatgaggagtcttagcataatgacaaatatttataatttttcaattaatggtacttgctggatccacactaacatctttgctaataatctcattgtttcttccaactgattcctaacactatatcccacatcttctttctagtcttttatctagaatatgcaacctaaaataaaaatggtggcgtctcca

SEQ ID NO: 447751 - DNA, 2136 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccaggtgctttgtcctccatgggagtataataaatgatgtggcaagggcttactctccatgagaggaatgtgtgacccacagaaggataa

SEQ ID NO: 447752 - DNA, 1094 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatgggtatggtttgtatgtgacgtgaaattttgtttaaaaagaaaatcacacattaaactttgaagttttcttaggatctttaccaaaacctagggaattgaaagtgtactttaggaaaaagtattaaaataatactaagttagcctgaagaaatactgtaggccatatgaggagttaaataattgtatatgactgtagggtttgttactttgatcaaatgattttatttggaatttgagattcttacaatttttgaaccattcagagtgtgatttatttggataatagactcttacccccctcccatttttaatacaaactcatagtttcacaaaaggtatatcaaaattaacattttatattgacctacttttctttcagaaagtgtctaacattgttccaagaccctcacattttgaatcctctttaaa

SEQ ID NO: 447753 - DNA, 2139 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaacc

SEQ ID NO: 447754 - DNA, 8190 bp, Homo sapiens
  misc_feature (8167)..(8167): n is a, c, g, or t
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttgtaagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgtaatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatgtgtgcccatggctgggcgcagtggctcatgcctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagataaaaacncacacaagaaacaaaaaaaaagg

SEQ ID NO: 447755 - DNA, 8195 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggattattttgttttctctcaccgtgactttccaggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttgtaagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgtaatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatgtgtgcccatggctgggcgcagtggctcatgcctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagata

SEQ ID NO: 447756 - DNA, 1892 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaatggcatcactattcatgaagttgtccaaacaagaaatacctatcatcgtttctctcctttatcccctgtatttagtcaccagtgcctatggatcatgcttccttaatatctttgaacctgtctacttctccatatctcattgttatttacttgacttagatttctgtccactttcacctggttttaatagccagccagtcataatagtagaggaatcagtcaagcaaaaatgctttggaagaattaaataagcaatgctgaacatcaggaattgtagatatccgtacagagagttccagtaaaattttatgagtccacgaccccttttctaagcagtctggtccatgttggtctcatacctcatatgcaggattcattcattcattaaatatttgtttcatacc

SEQ ID NO: 447757 - DNA, 1096 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatacgcgaagcctagagaagctattgtaagatgccaccccaattatggagtccagagccatgtct

SEQ ID NO: 447758 - DNA, 494 bp, Homo sapiens
gcttcgaccatgttggttgaccttgtatctcagattagtgtccctattccagtgccgttgaagtgagggtcctctagaacttagaaggaaaggactgacattgccagtgaatgcaagaattgtctctacttatctgcctctgtgaactccccaggagctgatagactacctgcgaacacattctcatagtgcagtgtatgccacgtcattgtcacctcctgtagtggagcagatcatcacctccatgaagtgcatcatggggcaggatggcaccagccttggtaagtctttcttttcttgaaacattgcataagtccacctagcagccaaacgtgctgtttttcttgagcttttttcctaaaataaatagtcaggtttactaataggcagagctggctggtgtgtggtttccatggacacttttttagtgtgtttgatacatatgccatgagaacgaccctggctcactttctgtggaattttcttgtttatag

SEQ ID NO: 447759 - DNA, 382 bp, Homo sapiens
tggacaagcatgaagaactagaggagcttgtagcaaggttcttaggagtagaagctgctatggcgtatggcatgggatttgcaacgaattcaatgaacattcctgctcttgttggcaaagtaagatactctgtcatttatgaaaactccctcatgtatatcttcttttgttttgaaaagcagtcagagtgagctaaaagctgttataaactttaggctaaacatagtttagccaaagatatttctaccacaaattgtttttcttttttttttttttttttgagatggagtcttgttctttcgcccaggctggagtgcagtggcaccatctcagctcactgcagcctctgtctcttggattcaagcgattctcctgcctcagc

SEQ ID NO: 447760 - DNA, 8161 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttgtaagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgtaatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatgtgtgcccatggctgggcgcagtggctcatgcctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagata

SEQ ID NO: 447761 - DNA, 2319 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctcaaaaaaaaaaaaaaaaaaaaaaaaaaaaaatttttggggggccctgggccctggaagaaagttttctaaacacaatcgttggggggcgcgggggccccataaagggctcagtggaaccgggtgccatagcgtgtccccgagggaaactccgcgcccacggaccacggcctgggatctcctaccaataaaaacgccgcgcgggcaacgcgcgtgttcggacaaccgaggggtccgaggcacacgggccccaacgggagtcagcagcgata

SEQ ID NO: 447762 - DNA, 1868 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaaccatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcgtctcgtcaaagggcctgtccagtagaggtaccaaccgatgacgggaatacttcagctgcaat

SEQ ID NO: 447763 - DNA, 1060 bp, Homo sapiens
cgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtgagtcttggttgggaaattatttgacaacaattacaaaagggtttcttcatttgagaaaatatgttattataaattgagtattctctcaaaataggagtagcagctgaggatacaatatgattggtttccttacatattcttcaattgttgagcttttttttttttttttttttaaattaatttattttttttttaatggaccattctggggtgtctcccgcaaagggggattgggagggccacataggaccaatagggggggaaaggtcagcagaataaccaggtgaccaaggttctcgtgttttcccaaggcagaggacccgggggcctggacctcccgaggggttggtgccccggggtacctaagatcggggagggggagataactctaaag

SEQ ID NO: 447764 - DNA, 2031 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447765 - DNA, 2070 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447766 - DNA, 742 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggaatgggaacctgttcgctggttttcagaaacgatcgatttttaagaccagaattttttcccctc

SEQ ID NO: 447767 - DNA, 1923 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgacaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcagtaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447768 - DNA, 1839 bp, Homo sapiens
cccccgggctgcaggattcggcacgagcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccgagtgttgcagcactttcttccttggctgtgaattctcccagtttctgccccttttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447769 - DNA, 2151 bp, Homo sapiens
ctgtatcagaatcctcatgttaagagctttacaagtgaccctgaagtctttagctgggtagtggcctcaaggtggacatgggggattgattaattgctcaagcatcagtttaaattagcagagattccagtttggagcttctacatattacctgtgggactctgagaatgaatctgcaattctctggcctcagtttcttcatttttaaaacaggtcaaatgaatgtgctgaatgtgttgaagtgaggatgaactgtgtgatttgtgtaccaattgcctgggtcattgcgtggcacatcacaggccatctataagtggcagctataacaatcaccatcacatttatgtacaaaattcagaaatatcgaatctatgtgtggcaaatatgaacattaaaaaatacaatgaaaatgtcagtctgaatcatacatagtatttggagcaaatagcgacttattttgctgctatttgcatttcctttcccagttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447770 - DNA, 1785 bp, Homo sapiens
cccccgggctgcaggattcggcacgagcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccgagtgttgcagcactttcttccttggctgtgaattctcccagtttctgccccttttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggaaacgatttgattataaagatcagaattttctcaccctgatgaaaagattcaatgtactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447771 - DNA, 1976 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatcccatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447772 - DNA, 1987 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447773 - DNA, 2029 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatcaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447774 - DNA, 1599 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactaggtgagaaacgttccctaatgtgggtctgtttttattgctttcccttccttccacttttcttcgtgtgactgcttagttgtatccttgaaatgcctaaaaacctatggctcagtaccagatattatatatgaaaaaaatgcagaatttcagagaacatttatctttttccagaatgtattcattcccctctcataggcaatattgtctgacaaca

SEQ ID NO: 447775 - DNA, 837 bp, Homo sapiens
  misc_feature (807)..(808): n is a, c, g, or t
  misc_feature (810)..(810): n is a, c, g, or t
  misc_feature (835)..(835): n is a, c, g, or t
  misc_feature (837)..(837): n is a, c, g, or t
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgacnnantgattgttccaggaaactcacacanan

SEQ ID NO: 447776 - DNA, 1977 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgacaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447777 - DNA, 1974 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447778 - DNA, 2073 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatcaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447779 - DNA, 1856 bp, Homo sapiens
cccccgggctgcaggattcggcacgagcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccccactttcttccttggctgtgaattctcccagtttctgccccttttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447780 - DNA, 2266 bp, Homo sapiens
ctgtatcagaatcctcatgttaagagctttacaagtgaccctgaagtctttagctgggtagtggcctcaaggtggacatgggggattgattaattgctcaagcatcagtttaaattagcagagattccagtttggagcttctacatattacctgtgggactctgagaatgaatctgcaattctctggcctcagtttcttcatttttaaaacaggtcaaatgaatgtgctgaatgtgttgaagtgaggatgaactgtgtgatttgtgtaccaattgcctgggtcattgcgtggcacatcacaggccatctataagtggcagctataacaatcaccatcacatttatgtacaaaattcagaaatatcgaatctatgtgtggcaaatatgaacattaaaaaatacaatgaaaatgtcagtctgaatcatacatagtatttggagcaaatagcgacttattttgctgctatttgcatttcctttcccaggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccgagtgttgcagcactttcttccttggctgtgaattctcccagtttctgccccttttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447781 - DNA, 1714 bp, Homo sapiens
ctggaaagaaggagtaggacaaaagaacattttatttctatccatgggccaaagtccactcagaaaaaaagtataaattggatctaggtgattgtttacttgacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaataggagcattgaggaccgtgttcaagaggaagctcactgccttgtggaggagttgagaaaaaccaaggaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcaagttc

SEQ ID NO: 447782 - DNA, 1957 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447783 - DNA, 1929 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgactggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447784 - DNA, 2096 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgatgaggaaatggaggcacagagaggtgaacttgcccgaagtcactcagcaggatgcagtgtgtccagctccaataccgagcccaggtctgagtgcccagacaggactccagaagatttggggaactatccactgccaagtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447785 - DNA, 1845 bp, Homo sapiens
  misc_feature (30)..(30): n is a, c, g, or t
  misc_feature (44)..(44): n is a, c, g, or t
tgggggaccgttattgccccctgggggccncccaggaaccatgngacccccggagtttcatcctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447786 - DNA, 1689 bp, Homo sapiens
aaccgcctgccccagacctccctgcccttgagcctcctttatggaaggcccttccccaaccctctccccacggcctctagggcctctccttctcctgaaaatcatctgccacacgtggaaagttccttgcattttcctaggaaatttccacattcataataacgtagacgatcgggtcccagctaacgagtggggagctgggagtcaaacctggcccctagagcccaaagcccgggcctgtctggagaagatggcacagcctcactgggggtctggcgacagccttgcggattaggttggggacattgttggggacattaatggactaattaattaccttaactcatggatgttttctgagtactgctgtgaaccagctgagtcccaggagagaggcggcaacggacaggaggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447787 - DNA, 797 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtgggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447788 - DNA, 387 bp, Homo sapiens
gggtcccagctaacgagtggggagctgggagtcaaacctggcccctagagcccaaagcccgggcctgtctggagaagatggcacagcctcactgggggtctggcgacagccttgcggattaggttggggacattgttggggacattaatggactaattaattaccttaactcatggatgttttctgagtactgctgtgaaccagctgagtcccaggagagaggcggcaacggacaggaggtcagaggtttgctgagtttttctgagggatggtgtatgtgtgtgtgttgcaggcagcacatgtcccagtgaaggtgggaggagagcggggtgtccagccagctgggcccctggccaccccctaagctcctctttccttcccctgcag

SEQ ID NO: 447789 - DNA, 1868 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447790 - DNA, 1992 bp, Homo sapiens
ggtctggcgggagcgcgggggtttttctgctgccgcttcctttctgcccttttaatttccccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcgggctgagtcccaggagagaggcggcaacggacaggaggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447791 - DNA, 1843 bp, Homo sapiens
tgttgagagcacgcagtaaatggcagtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccaaaaaaaaaaat

SEQ ID NO: 447792 - DNA, 904 bp, Homo sapiens
agaaaagtccagaaaccagcacactgttctttccatttgtagttgaaatcagtattcatttggcatggctgagcctccacaggaatgcgttgtggcatctcttccatagttgagtgaagaagaaaaggcaagggaagaaagcatacccaccagtaattaattttgtagaatttagtacacctctttaggtttaaaattccaggagaagggttctcatctaggacaccagggatgtacagaaaggcaccgttctttatcagctgcctaagcagtgtcatccccaggctcatggagtggggttgtagagggagaacaggccagaaggcatcttgcacggtggggtctccaaaggtgtccctaatccacagctggggagctaggacccacaggggctcccaagtcaagattctgagccagttgttatgagatgactcctaggtgttagaattgccttagtgcttccaggtgattgtcatttccagccaggcagagaaacactatcctaaatgaaagcccagtgagttttcaggatcagctatcaggtaaaaggcactgagctgtagacagaagattctgctacttagtaactgtgagaccttgggccagtcctctgccctctctgtgcctgtttctttgtctataaaacagggataatggtgccccatgaggtgtagggagaatcaaattccataatctaggggctcaatcaagttctgtaaatgtgaaataccatggcagcatccagtgcagtgctcgcacagagtcaagtactggtcagccagcattgaagccttgcattgtttagtctgggagatgggctggagcaagcagtaactgcctttctctctggccttgatggggtcgaggctattagtagtgccaaggagatgaagtctttatatct

SEQ ID NO: 447793 - DNA, 2562 bp, Homo sapiens
  misc_feature (1453)..(1453): n is a, c, g, or t
ccaggcgagaggcacctgcgggatgcctgtggggtagctggttcattctgccatggctgcaaactgggactggcagacaattcggggaagggaggagcatgctgaccgcctttgatgttggagccagggtctctgagaaactgcattctctctgctttgctcttcgatctttttttggaaattttaaaatatttattggaacagaaatagaaacataagctccaaagaaacaacatgacaaactttataagtaaatgtaattttcccctaattaatatatttactttgtgtttgtggtttacaaaatgatggctctttcccttctatccctttgtacctatgtgtatctggcaggaaagttcttagctctggctatgggcacacagaagcttcctatacatgattatgttcaaatgttgatttactttccccagaataaattggggaactggcactgtctggattggtgactgtctggatgatctccctgtccctgggcccctgtgtgcacccttgctgttaaatttgcaagagccgggctttggggcgccggcccctcagggtctcagaagctgtccctcttgagcagatggcagtccctgtggggttgtcgggtctcccattctctgtccagtcatggtctgcatcatctccagtgtccagcctggagtcagggttgggcagccgatggtcctgatgggagggtcccctgagcctcctttcagatggcatttagacgtagcttccgcagctgtcaatggctcgctgcccacggtggcatgtggggaagtttttaccttcccccgggacagctgctttgcgagctctgggctgagaaaggcatttgcccccttctttgtcttttgaaaccagcccttccctcttttttgcatccagctctgagactggatgcaattccgtacccatccgccttctccttaacgctcgctttcctttctttattagaaacaatccactttcccttcacctctccctctcgagcaggatgtgctcctggtctctgtctattgtccagccgtcagaacagccgacagcctgtcttcccactcagagagaagccagctgtcttcaccatcacctgcctgccccgcccttagctaagaggctctgcctggggtgcactgcccacagcccccggctctcggcccctcctgcacccagggctgctccctcagccccaggtcctgccagtcctgtcgaaggcagccacagtgaggacacagctgaagtactctccagcctgagggcagacacggcccactgttgggactcctggtggagcattccctttgtccctaaagaacagatttcctcataggtcagcaaagccccacatgagggcccaggacagcctgaacagagatagtgctggggccaagaagatgggagtggggtgggcgagggagcagagatgggcagggctgtattggancctggctttcagaaaacgtgaaagaagagatggtagattataaaggaagtcaagctgagctcagggcgggagcaagtctctcctccctgtgctgaggggaggtgcctctggcgggcagggacctccgggcaccggttccagggcccgggccccagagtgggaagtcgaggccgaccctctctcttggccctgctgttgcacccaggacaggccagccccgggtcatgctcctccatcctcagcctggatgcccttcacacctccgggcctttcctaccactgttcactcgcctggggatgtcagcgccaccctctgcgttctcctgtgtctgggcacagggcaggctcccctctgctgtgcacgccacctccatgcgccatacgtggacacctgggtgcctccactggccctgccccaggttcagatggggctcgcctgctctgtggtgttgggtgggtgagaacagtttctgcccgagggtccctgctgaccccctcctgggtggggtgttctctttctcagaaagaagacggcaccgtgaaccgggacttcaagaagaccaaaacgagggagcaggtcaccgaggccttcagagagttcactaaaggaaaccataacatcctggtgagtctggcacctccagagagggtctctccagccagccagggagggacaactgtgtctactctggaggtgcccatggggaggacaaggcacccccagggacagcacaccccagcccgagttcgtagggctctgtagagaggccactggcagagacttttgtggctctctcactctgccctttcaaaagtcaaaggcacgccgggcacagtggctcacgcctgtaatcccagcactttgggaagctggggcaggtggatcacctgaggtcagaagtttgagaccagcctggccaacatggtgaaactccatctttactaaaaacacaaaaattagccggacatggtggcgcatgcctgtaattccagctacttgggatgctgagacaggagagtcacttgaacctgggaggcggaggttgcagtgagctgagattttgccattgcacttcagcctgggcaacaagaatgaaactctgtctggg

SEQ ID NO: 447794 - DNA, 6162 bp, Homo sapiens
tcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagctttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 447795 - DNA, 3601 bp, Homo sapiens
ctcatgtcgccttccctcccacgtaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 447796 - DNA, 3110 bp, Homo sapiens
tcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagctttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggccatcaaactctgaacagtcatgcaaccggagcttctgatgatggcctcttctgctggggacccttagacaggcatctgagggacctctgactgccatttcccaaaaacagtgccccctgtcagcaggaagcagttaagatca

SEQ ID NO: 447797 - DNA, 2545 bp, Homo sapiens
tcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagctttcctgcataccctggaccagcagaaacctagagtgagcaaatcatggaggaagataaaaaacatggtgcactggtctcccttcgtcatgtccttcaagaagaagtacccctggatccagctggcaggacacgcaggggagtttatcaagggcaagcttgccaatagggcaagggatcccttgaacgaaaggcacctggtgaagtcaaggagacaggaggcgttgcccttggaacccggtccttagattgggtagcgaattgatagcatggaggggaccccttttcgggtagccattgccataacgca

SEQ ID NO: 447798 - DNA, 361 bp, Homo sapiens
ttaatcgtgcattgaacaaacactgaagtagcccggagcagacactgacaggggcagtatctccacggtcgaaaagggcgtgcagggccggcttggcgtcgccactgccgggatcgccgggcccctgaaccgaagagctttcccccctctttcgcactcctcttttttgtcttccatagcttgtgagaaaataatttctgagcatttttacttttaaagccatctcgtccctacgaggtttgcgcctctgggcatgtagtctacacaggacctgagaatctgagaaactgcaggtaagtttggcggccttttaatggctctcgcctctgaacaaccctcttttccctcactttctgctctg

SEQ ID NO: 447799 - DNA, 3018 bp, Homo sapiens
tcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagctttcctgcataccctggaccagcagaaacctagagtgtgacttcttgggaagtgttcccctcagtggtactgctggggcaacgtccaataccaagaatgatgtatagcatatttcatcttcctacactactctctggaaagactgagccaattacggggtcatctgtaaagtctaagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaataaaaaaagattgtacttt

SEQ ID NO: 447800 - DNA, 6567 bp, Homo sapiens
tcctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggctgagccgggagcgccgggaggaggaggcgccggcggcggagcaggagcgggagccgcggcggcgggcagcgcgggacccagtactatggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatcaggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagctttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggctctcttcctgttctgcacccctctccccatgggaccttggagaaaactgaactgttacaaacccctgcacagtgcctgtcaaacagatgcaaaccttcctgaataaagccttggagaccaagcgctgtctgtggtgtgatccttctggcccccagccctgagacctggctgaggggcaggctggggagtcttaggaagctagagggcccacatgggggctgttaggggagtgggtgtcagactgggtaacattttaatttgtaaagaatataaaccactctccaaaatgagtcttttcaaccctcatgaaactttgaaatagtagctcagagactagaacatcaaccaagaagcactgtccccaagtaggggggtctccggtgcagcgatcgcttctggggccttactctaagctagactggggctgaacacgcccattggagttcccgttttacccagatcaattccctgaacaaagatttatagtctgttttacagatgaggaaactgaggtttaaatgaagc

SEQ ID NO: 447801 - DNA, 5346 bp, Homo sapiens
  misc_feature (1453)..(1453): n is a, c, g, or t
ccaggcgagaggcacctgcgggatgcctgtggggtagctggttcattctgccatggctgcaaactgggactggcagacaattcggggaagggaggagcatgctgaccgcctttgatgttggagccagggtctctgagaaactgcattctctctgctttgctcttcgatctttttttggaaattttaaaatatttattggaacagaaatagaaacataagctccaaagaaacaacatgacaaactttataagtaaatgtaattttcccctaattaatatatttactttgtgtttgtggtttacaaaatgatggctctttcccttctatccctttgtacctatgtgtatctggcaggaaagttcttagctctggctatgggcacacagaagcttcctatacatgattatgttcaaatgttgatttactttccccagaataaattggggaactggcactgtctggattggtgactgtctggatgatctccctgtccctgggcccctgtgtgcacccttgctgttaaatttgcaagagccgggctttggggcgccggcccctcagggtctcagaagctgtccctcttgagcagatggcagtccctgtggggttgtcgggtctcccattctctgtccagtcatggtctgcatcatctccagtgtccagcctggagtcagggttgggcagccgatggtcctgatgggagggtcccctgagcctcctttcagatggcatttagacgtagcttccgcagctgtcaatggctcgctgcccacggtggcatgtggggaagtttttaccttcccccgggacagctgctttgcgagctctgggctgagaaaggcatttgcccccttctttgtcttttgaaaccagcccttccctcttttttgcatccagctctgagactggatgcaattccgtacccatccgccttctccttaacgctcgctttcctttctttattagaaacaatccactttcccttcacctctccctctcgagcaggatgtgctcctggtctctgtctattgtccagccgtcagaacagccgacagcctgtcttcccactcagagagaagccagctgtcttcaccatcacctgcctgccccgcccttagctaagaggctctgcctggggtgcactgcccacagcccccggctctcggcccctcctgcacccagggctgctccctcagccccaggtcctgccagtcctgtcgaaggcagccacagtgaggacacagctgaagtactctccagcctgagggcagacacggcccactgttgggactcctggtggagcattccctttgtccctaaagaacagatttcctcataggtcagcaaagccccacatgagggcccaggacagcctgaacagagatagtgctggggccaagaagatgggagtggggtgggcgagggagcagagatgggcagggctgtattggancctggctttcagaaaacgtgaaagaagagatggtagattataaaggaagtcaagctgagctcagggcgggagcaagtctctcctccctgtgctgaggggaggtgcctctggcgggcagggacctccgggcaccggttccagggcccgggccccagagtgggaagtcgaggccgaccctctctcttggccctgctgttgcacccaggacaggccagccccgggtcatgctcctccatcctcagcctggatgcccttcacacctccgggcctttcctaccactgttcactcgcctggggatgtcagcgccaccctctgcgttctcctgtgtctgggcacagggcaggctcccctctgctgtgcacgccacctccatgcgccatacgtggacacctgggtgcctccactggccctgccccaggttcagatggggctcgcctgctctgtggtgttgggtgggtgagaacagtttctgcccgagggtccctgctgaccccctcctgggtggggtgttctctttctcagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggtcattggcagctccctcctcttcatccacgacaagaaggaacaggccaaagtgtggatgatcgactttgggaaaaccacgcccctgcctgagggccagaccctgcagcatgacgtcccctggcaggaggggaaccgggaggatggctacctctcggggctcaataacctcgtcgacatcctgaccgagatgtcccaggatgccccactcgcctgagctgcccacgccctccctggcccccgcctgggcctcctttcctcctcctgtgcttcctttctcgttcctaacttttccttcacttacacctgactgaccctcctgaactgcactacaagacactttgtagaagaggagatgagagtttctagtcattttcctaacttcagggcttggaggtggtgtttgcactgctttttgtagagagggtcacctactagaagagaaatgcccagtcttagaggtgggtcaggtgtagagctggagggggtccctggctgctgaggggaccctaccagatgagccctgcctctgggagccccctaggaagcaccagcctggacctaccacctgcggaggcctgctgccccctggcggccagtgctgttagagtgctgccaagcacagccttatttctgccggggcctccccaccggagagcccagggggccggccgggttcctggtccctggctgggagcagggctttctggtagttggggcacaaaaccatcggggaaccacatgttgactgtgagcaaagtgtcttccgattagcagcctcagggatgccctggtggcctctccagggctgctcaggcaaggccccccacccatctggtatggaaacctgccggctccaggccagacccaggagccaagagaaggctgaagccagcttggctgtgttctctgatctaggccttcccagaggaggcgagcagaagctgtgccacttggaattgcaacccatgagttcagaaggcacactctgccatgctgagctccaagggtgctaccaggggaagatgggatctatagagtctctgggccctggccccagggaggagcacatttttcttgaccctcacctacctggtgctagttggtcaaccctgcctgcatacatgggctcctgtcatggggcccagagtcccttgcagatatagaaataggggaggagctcaggtctgcgccaggcaggaagaaggcaggcttctggcttccagaggtgccgcggtggcctcctggcatcatttgttattgcctctgaaacaagccttactgcctggagggcttagattcctgcttctccaatgtagtgtgggtatcttgtagggtatgtggtggatgccagggcgtgctccaggcacctcttcctgaagtctctgcatttggagattcgtggagaacctatttaagcccaattttaactgaaagccagtgagtctgatatggaagggaatgtaaaatttgcctgacttcttaagaacaaaacccccagctctgtgccccatgctccttggggcttgccacccactcctttgctgtcagaggtacaggagctgggagagtccaggagctagggacacagagggagactatggaccaaggtgtgtgtgtctggaggaaccactgcccaccccaccaccccggggtctctggggaactgtcaacctgcccacgggacatgtacatttccccttttgtgctggaagtgtgagtgacacttgctgggggtggagggtgggacacatgaggatgtataagtacagattttaaaaaaggaaatcaacttacacttcctggctcttgtttaaaacagtggtgagctcctgtgtgggccgacttgctaaaggtcacacacgcgcccggtggagcacgagagacctcgtggcagcatgtgatctggaaggcaggcaggacgggggcgttggggagccaaagtcaactctgggcctctggagctatagtgacttttgggctagaagggaccctggtggtctgtgcttcagccatttgcagggcaggggcatcattaattcagacgtaaagattctatgaatatggactggccaaaagttatccttactccatctgtgaaagaagtttgctaaagcaaatcatgatatgaacaaaaattacaggggacctgtttaagagaacaaaatgttccaagcactttaggcagacaccagctgtttgcaaacaatgtgctaatatgcaaatgatgtgcttattaaaggaggcccatggggcctcttattggcaatacttggctgtgggttacattaaatatgtgaacatagtatgaagtagcatcattttagggttattctgttacttagggtttttgttttctgttttttttttctctttttttgtatttaccgtgctagttctcttctacacctactctgtctctcaagccattttgccactcgcttccctgccatctggcccttccctttgtctcagtgggatagatggattgtgaaatggaatctcccagaacccctgccctggcagcctggaagaccgtgcctgcccagccctcgtcaccacagggactccttgggtcctggcagtgcatgtgccagcaggcaggacaaactctgtgtacctgtgcccaggtgaatgggcgcagggtcctcttgccctgtcctgcggggggccccacgagttcctggcattcagcactgcttagcattctcggaaggtttcttcaactgcttgcttttcccaggcttgcctttagtgtcatgtaagacatttttaagttatatttattttgttgggttttaaaattgcacagaacactaagaccgaaaggctggactcttgtttctccttgaaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggctctcttcctgttctgcacccctctccccatgggaccttggagaaaactgaactgttacaaacccctgcacagtgcctgtcaaacagatgcaaaccttcctgaataaagccttggagacca

SEQ ID NO: 447802 - DNA, 5297 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447803 - DNA, 5326 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447804 - DNA, 1023 bp, Homo sapiens
ggcaagccaaggggcaccagtagatgcgggagaaggactggtacatttgcagacaccaggcctgcttattctgcatagacaatgtaacatggctgagctgcccagcagagcttcggagaattacgctgattcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447805 - DNA, 5204 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttattgtgctgtgggaatgcctctgtattttttcccctctttggccatctttttctgaaaataaagtgatggatcctctagccaa

SEQ ID NO: 447806 - DNA, 5229 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447807 - DNA, 3456 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctgatttgttttgagtgacatggtttggaa

SEQ ID NO: 447808 - DNA, 341 bp, Homo sapiens
gaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaacccagtctctccgtgtttgtatagacttacctgagtgatgcagtggtttagtctggttgttggccagcattgtaacccaagaatccaggtagctggagactttttttctttct

SEQ ID NO: 447809 - DNA, 5186 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447810 - DNA, 4978 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447811 - DNA, 5328 bp, Homo sapiens
  misc_feature (737)..(738): n is a, c, g, or t
  misc_feature (745)..(745): n is a, c, g, or t
  misc_feature (759)..(759): n is a, c, g, or t
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatnnaacaacnattttttaattttnaaacacaatttttttttttaaaacactttaaaatttttaaaaagttttatattttaaaataattaaaaaactttttaacacaaaaataacttaagcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447812 - DNA, 2909 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 447813 - DNA, 3553 bp, Homo sapiens
ggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaagtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggcagtgcaaagccctaccctgtagagggtagtccaaggaagcgtgggaccctgctcacccagagcccccatgactaggactctccctgcacctgcaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctgatttgttttgagtgacatggtttggaa

SEQ ID NO: 447814 - DNA, 432 bp, Homo sapiens
tagtgattatttcagggtctgttaccagagcgtgtctgccgtattcactgtatctgcagcttggagcacagtagactcaaatgcttgcatgccagctcttcccctgtacagcctggattaacactgatgctagcagactcctttgcacaactgattagctttcgtaactaccacagctttcttactgctagtcattctgtgatgggattaagctaggtcttgaactccttaactccagttccttggctactactgagtacatactgaataaggcaaaattgacttacctcttttgttttgctcccctgtggtagaattctaggggtacagaccgtcggacgatctgataccatagagtttctggcgtatacactggatctggagcttggagcacaacgacacgaatgctagaatgctagcgcttcccctgta

SEQ ID NO: 447815 - DNA, 1054 bp, Homo sapiens
tcacttatagtgttttcaaggctcatccaattagaatttcattcacttttaaggctgaataatattccatgcttatgtgcaccgtgggttgtttatccagtcatcctctgatggacactcggttgcttccaccttttggatattgggtatagtgctgctatgggcctgagtgtacacatatctgggtgagttcctgctttcagttcttttgggtatgcccaaaagtggaattgttggctcatatagtaattctatttttactttcttgaggaatcactattctgttttccatggtggctgcaccactgtatactctcaccagcagtgtacaagtgttccagtttctccatatcttcaccaacacttggcctagtgaagtttgccatatttttatgtccttattggcattccttttttttttttttttgtgaaacagagtcttgctctgttgccaggctggagtgcagtggcacaatctcggctcgctgtaacctccacttcccaggttcaagtgattctcctacctcagcctcctagctactcggaaggctgaggcaggagaattgctccagcccaggagtttgaggttacagtaaggtatgatatcaccattgcatttcaacctgggcaacagaccctgtctctgaaaaaagggaaaaagaccttgtgagctgtctacgtgtactctatgtctcaggagactcatatcctgtaatttttctaaatggcgtctccatgtggtctttcatgaatgtttgtctggtattctctatccttttactttcaacttttctttaccttctactgaaattatgtcttttgtaaacagcccatgattatttatttagttatttatttttacccccctgcactatttgtcttgtaattggagtgtctgagtccattatgtttaatgtaattattgacctcattgggtttaagtctgtccattgtcatttgctgccttctaatattatctctttcttgctcaactatttttcttatgttaccttctttagatgaataaaaacctttgcattataaaaaattctaa

SEQ ID NO: 447816 - DNA, 1925 bp, Homo sapiens
ggatcacaaactgttgggagaagagtggtatcttgggcctctagctgatctgatgaatattaatatccaatgtcctgtagtgaagtcatgtgtgcgtgtaacatcacttcttcacgcagtgtcataggaaagtgggttcctggaccccaggttaagagcctaagcactaaaggcacagagctagagctctaggaggggagggatggctggggtggaacctcgtcttgtcatttagtcctggggccttttcactccttacatggtgggtggtgggcgtctggcaggtgccgatgttgatggagtcaagggagggaactagccgggacagggaaaaacagggttggagagataattaaggtggacattattttttctgagcgtaagtcgtggctggaaatctggagagcctgaaagagtatccccctacccaaacctgttttttccttttccctcaagcctcatttggccacaggcccagtgtcaacaccagggggcgccacagaccatgaaggcaccgtgcagctgggattgtttgtggtcggctactgggtccctgacttaaccaggggagccaagaccctgtagccaagtggcctggattcaacctgcagctcaggtcttactgacacttctccccctggtgcctcagtttcttaatctgtgaaatggtgaggacattacagcatttacctctggggcgggtttctcaacagcagcactattaacaatttgggacagagaatcttgtggagtggtctgtcctgtgcattgtgggaggtttgccagcaacaccccactcaccccctcccaccaatccccatgtgacaaccgaaaatgtcccaggatttttaggtctcccttgggtctagaagctgcacttaggcattttcccacctgacacttgagttcatctctgctttggtccacataaggccactttaaaaaaatgttgtttctttaaagattctaaccatcttttaaacaaatccattttcttcctctatttctgcattcagttaatccttccaaaccctttgtttagtatatcttgaaatgtatcaattcctgttctagtaattaacatatgtgacttgcatgatatctgctatgacccctagtagagctctgattcctttagcacagggaatgtgttctcgattctgctctggatgatgtaaatcaatttattttactttacttgtctgggatgttgctcctcatctgtaagatgtaaatgtggatatggcttggattactaagtggttttatttcttaattcacctgacatttgttgtgtacctgctgcaagtcaaatacatggcatggtattgtttccttgttcacaccacagcaaatgagaaaatgagacattatagccaggtgtggcggcacaggcttgtggtcctagctactcggaaggctgaggcaggagaattgctccagcccaggagtttgaggttacagtaaggtatgatatcaccattgcatttcaacctgggcaacagaccctgtctctgaaaaaagggaaaaagaccttgtgagctgtctacgtgtactctatgtctcaggagactcatatcctgtaatttttctaaatggcgtctccatgtggtctttcatgaatgtttgtctggtattctctatccttttactttcaacttttctttaccttctactgaaattatgtcttttgtaaacagcccatgattatttatttagttatttatttttacccccctgcactatttgtcttgtaattggagtgtctgagtccattatgtttaatgtaattattgacctcattgggtttaagtctgtccattgtcatttgctgccttctaatattatctctttcttgctcaactatttttcttatgttaccttctttagatgaataaaaacctttgcattataaaaaattctaa

SEQ ID NO: 447817 - DNA, 1587 bp, Homo sapiens
acaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaagatgtatttaattcgtcttcaaatttggtatgtaacttgtatgaaagaaattttaatccaagcagattttgtaatgagataatgaagaaattaaaactacaggtgacactgtgctgttgctctctgacccagtggaagtctacatatgtgtgaaaatgaatacaccttctctctccaggttgcaatggttcagttcactgatgatcccagaacagaatttaaactaaatgcttacaaaaccaaagagactcttcttgatgcaattaaacacatttcatacaaaggaggaaatacaaaaacaggtatgaccaaaagaagcccagctaaggctcaaagtaattcattatttgtaactactgaaatgaccttttattttaaggcatagtaattttttaaagattttttttttcattaatttaagaactttgttcccaccctttcttctccagaaaaacaaaaatgggagggagtgaaatcaaactgttgcctttctttgtttcaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggtaagatatataaacaatagtggctaccaaatatgatgttagaattgttattttctaaatacaaatttataggctatatcagcattacttaaatgttttaaaatatttcttcatattaactagacagtgtaatttttaaaatactttctggtatacaaatctgtaattgtactgctttgttagagaaaataggttattttctctaacacttttgttacatacaggatgccctttatatggaactctagcaattaagtactgtaagaaaaggaccagggaaagaatcttattacagaaactcctcagcctcttaatcatacccaaatgtccatcgatgacagactggataaagaaaatgtggcacatataagccatggaatactatgcagccataaaaaagaatgagttcatgtcctttgcagggaaatggatgaagctggaaaccatcatcctcagcaaactaacacaggaacagaaaactaaacaccacatgttctcactcataagtgggagctgaacaatgagaacacatggacacagggaggggaacatcacacacgggggcctgtcgggggtggggggcaagggagggagagcattaagacaaatacctaatgcatgcagggcttaaaacctagatgacaggttgataggtgcagtaaaccaccatggcacacgtatacctatgtaaaaaacctgcatcttcagcacgtgtatcccagaatttaaagtaaaattgtgt

SEQ ID NO: 447818 - DNA, 603 bp, Homo sapiens
ttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggggtgactctcattgcatgtatgcctgaaattcagcaacttatgttagaaatcttttaatgtggcattactgctggcagaagatttcaaaaggttagtttgaagttataatttgtgaaagtaaactcagatattcagtgctctcacccatccaaagaacattgtaacttaccagctcttcttgctaaaggatgaggaatcaagtgattttgctatgataataaaagcttttctgtgttatgattaaactagctgaaagtg

SEQ ID NO: 447819 - DNA, 6211 bp, Homo sapiens
  misc_feature (1862)..(1862): n is a, c, g, or t
ttctcttctccctcctgccgccttatgaacagggtgactgtttccccatcggccatgattttaagtttcctgaggcctccccagtcatgctgaactatactgttcctaagagcatctgccccagtcaacttctcatccacagatattaatctcagtcaacctccagatttttagacatattttgaaagtctttcatcaccagatttcaaaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaa

SEQ ID NO: 447820 - DNA, 6039 bp, Homo sapiens
  misc_feature (56)..(56): n is a, c, g, or t
  misc_feature (1827)..(1827): n is a, c, g, or t
  misc_feature (5935)..(5935): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaaaaaatggttatgattctagttttctaacaatttctgtaatgtatctttcccttcgtctattnactaactgtctgaaaccttatggggaacggtacaggggcgtggtggattaagacatccactggttttttaccagcaggatatctctgggtctcctaaggacccg

SEQ ID NO: 447821 - DNA, 3446 bp, Homo sapiens
  misc_feature (56)..(56): n is a, c, g, or t
  misc_feature (2112)..(2112): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaaggtaaaagaataatagaataattatctgattctaggtttaggatttgtgttggttttgtttgcctgttcatttcaaaccaggatattaataaagtatatttattgtgct

SEQ ID NO: 447822 - DNA, 6118 bp, Homo sapiens
  misc_feature (56)..(56): n is a, c, g, or t
  misc_feature (1827)..(1827): n is a, c, g, or t
  misc_feature (5076)..(5076): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcgaganagaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaa

SEQ ID NO: 447823 - DNA, 2090 bp, Homo sapiens
  misc_feature (56)..(56): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttcagattttgcttaaactgtggagcaatggtttcagtttagatgatggagaattgagaccttacaatgaaccaacaaatgctcaatttctggagtctgttaagagaggccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatg

SEQ ID NO: 447824 - DNA, 2965 bp, Homo sapiens
  misc_feature (56)..(56): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttcagattttgcttaaactgtggagcaatggtttcagtttagatgatggagaattgagaccttacaatgaaccaacaaatgctcaatttctggagtctgttaagagaggccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggagaattgcttgaacccaggaggcagaggttgcagtaagccaagatcgtgccactgcactccagccttggtgacagagcaagactccgtctccaaa

SEQ ID NO: 447825 - DNA, 1711 bp, Homo sapiens
ttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggggtgactctcattgcatgtatgcctgaaattcagcaacttatgttagaaatcttttaatgtggcattactgctggcagaagatttcaaaagagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggagaattgcttgaacccaggaggcagaggttgcagtaagccaagatcgtgccactgcactccagccttggtgacagagcaagactccgtctccaaa

SEQ ID NO: 447826 - DNA, 557 bp, Homo sapiens
gcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggtaagttttattttgttttgttgtaaaaagaaattataatcctttctaaaaatttactaacttcaaattattttaaatggccttcttcaaggtttcttcaataatttttaaaaattattattccaagatcgaggcagatttggataaaaaatagaaatgattaatatcatttaggtactattaaaacttttacaatcagaaagccaaaagaaacttacggaaaaattaccttaaaatacctaatattttggtagatatcatatgaaattatatcctgaatactatttttcttgggcacaatggttctttaatattttttgagtcataggactcattaagggtctgatgaaagctatagaatt

SEQ ID NO: 447827 - DNA, 202 bp, Homo sapiens
gaaatcttttaatgtggcattactgctggcagaagatttcaaaaggttagtttgaagttataatttgtgaaagtaaactcagatattcagtgctctcacccatccaaagaacattgtaacttaccagctcttcttgctaaaggatgaggaatcaagtgattttgctatgataataaaagcttttctgtgttatgattaaact

SEQ ID NO: 447828 - DNA, 399 bp, Homo sapiens
gtaagtcactggttcttaattttgtgggccaggggcattggacattggcccattttaaaatctgatgaaactatgaacccagctccaagaagaaacatcttaatgtgataatcagtgaattaattagtatgtagctgcccacccactaagccactgtcctgcttactgttgacagggtgactctcattgcatgtatgcctgaaattcagcaacttatgttagaaatcttttaatgtggcattactgctggcagaagatttcaaaaggttagtttgaagttataatttgtgaaagtaaactcagatattcagtgctctcacccatccaaagaacattgtaacttaccagctcttcttgctaaaggatgaggaatcaagtgattttgctatgataataaaa

SEQ ID NO: 447829 - DNA, 1970 bp, Homo sapiens
aacaatagtccttacactgaattcatttatcctgaaatggcagacatcattcatttttcttgaaatggcagaatagcagctgcagacattaatctatggtacataccaagcaattcaactttttcttgtaatgtcagacttttctcttcttcttgggagcacttccagtatcactagtgctagtggcatcactttatacgagtcttatggtattattcaaagtttacagtattgcattaaacacgatgaaaaatacatgagaaccacaagagattaccttttactgtggtaggcaatttactacagagacaaactgctgaaacagaggtgatcagtgccgattaaaatgtgtggcattttaagtggatacttgcagcacctgaactcactgcaatagcaataggaggtggctatgaaattattagagaagtatagtatataccacagtaactttttgccactctcacttaatactgcatctttacatttgtttcctcgtgccgaattcggcacgaggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaa

SEQ ID NO: 447830 - DNA, 6176 bp, Homo sapiens
  misc_feature (56)..(56): n is a, c, g, or t
  misc_feature (1827)..(1827): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaa

SEQ ID NO: 447831 - DNA, 3364 bp, Homo sapiens
  misc_feature (3260)..(3260): n is a, c, g, or t
aaaggctaggtagaggctggggtgaaatcggccgagggacagccatggtgtaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaaaaaatggttatgattctagttttctaacaatttctgtaatgtatctttcccttcgtctattnactaactgtctgaaaccttatggggaacggtacaggggcgtggtggattaagacatccactggttttttaccagcaggatatctctgggtctcctaaggacccg

SEQ ID NO: 447832 - DNA, 5640 bp, Homo sapiens
  misc_feature (56)..(56): n is a, c, g, or t
  misc_feature (1827)..(1827): n is a, c, g, or t
  misc_feature (5536)..(5536): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgantggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaaaaaatggttatgattctagttttctaacaatttctgtaatgtatctttcccttcgtctattnactaactgtctgaaaccttatggggaacggtacaggggcgtggtggattaagacatccactggttttttaccagcaggatatctctgggtctcctaaggacccg

SEQ ID NO: 447833 - DNA, 3560 bp, Homo sapiens
acaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaagatgtatttaattcgtcttcaaatttggtatgtaacttgtatgaaagaaattttaatccaagcagattttgtaatgagataatgaagaaattaaaactacaggtgacactgtgctgttgctctctgacccagtggaagtctacatatgtgtgaaaatgaatacaccttctctctccaggttgcaatggttcagttcactgatgatcccagaacagaatttaaactaaatgcttacaaaaccaaagagactcttcttgatgcaattaaacacatttcatacaaaggaggaaatacaaaaacaggtatgaccaaaagaagcccagctaaggctcaaagtaattcattatttgtaactactgaaatgaccttttattttaaggcatagtaattttttaaagattttttttttcattaatttaagaactttgttcccaccctttcttctccagaaaaacaaaaatgggagggagtgaaatcaaactgttgcctttctttgtttcaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctataggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtttgttccaggggttgcctctccttatctacggggattactttgtacatgcagataagttttcgcaaacctatttccattttcttttgtaagcaaataaaactttaaaacaaaa

SEQ ID NO: 447834 - DNA, 2086 bp, Homo sapiens
  misc_feature (56)..(56): n is a, c, g, or t
atcctgggctcccagctggagaggcggaggcagctccagggggctggaagtggaancgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttcagattttgcttaaactgtggagcaatggtttcagtttagatgatggagaattgagaccttacaatgaaccaacaaatgctcaatttctggagtctgttaagagaggggtgactctcattgcatgtatgcctgaaattcagcaacttatgttagaaatcttttaatgtggcattactgctggcagaagatttcaaaaggttagtttgaagttataatttgtgaaagtaaactcagatattcagtgctctcacccatccaaagaacattgtaacttaccagctcttcttgctaaaggatgaggaatcaagtgattttgctatgataataaaagcttttctgtgttatgattaaactagctgaaagtg

SEQ ID NO: 447835 - DNA, 1665 bp, Homo sapiens
gcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacgtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggagaattgcttgaacccaggaggcagaggttgcagtaagccaagatcgtgccactgcactccagccttggtgacagagcaagactccgtctccaaa

SEQ ID NO: 447836 - DNA, 3710 bp, Homo sapiens
  misc_feature (3)..(4): n is a, c, g, or t
  misc_feature (6)..(6): n is a, c, g, or t
ggnntncccggccgggcgcacccgcggggccctgggctcgctggcttgcgcgcagctgagcggggtgtaggttggaagggccagggcccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccgtaagttatagccactgtggaaagtagtatgaaagttcctcaagaaactaaaaatggaattc

SEQ ID NO: 447837 - DNA, 527 bp, Homo sapiens
gcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctgggtaagtgcagcgctggtggccgtgggttcaagtcgcccctggccacctggcgcactccagggtctagggttcgtggctcactctctccagcctcactttcctcttctgtcacatagcagcgatcaaaatcatccctgaccgccagggttgccctggagacctctgatagggcatgcagtagacgtttaataaatgttgcatccttcccacttcctgtgcaaacctgaagctgcggtcacgctttggaggagtgagggcgacctgccatccaggtcatgtgttcatcct

SEQ ID NO: 447838 - DNA, 4500 bp, Homo sapiens
atgcgctccggtgcagcgccccgggcccggccccggccccctgccctggcactgccccccacgggccccgagtccctgacccacttccccttcagcgatgaggacacccgtcggcaccctccgggcagatctgtcagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447839 - DNA, 4046 bp, Homo sapiens
ggagagacatggaaaataagcccttcttcctttctcccctggggctcgtgaacagcttagctaagaggctgagctgtgctggggccagtcgtgctggttcctatcctagctttgccacttatgagctgcatgatcttggagaagtcacatcgcctctctgagccttggtgccttcacctgccaaacgagatcaagtgcttagagcaatacttggcagatcataagtactcaaaagacagtggctgtgattgctttcgctattttgcagcccagtaggacgagggcagtacattctgtgctgttgaacctgtcacccactgggtgagcaataatggtgcttccttcagaccaaggcttcaaactcctaggaaatgttctccagggccctgagccttacaggcttctgacctctggcctccgtctccaccaggaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtacaggctcggggcattgatggacgggcacagggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447840 - DNA, 4437 bp, Homo sapiens
gcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447841 - DNA, 3977 bp, Homo sapiens
cagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctgggcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgggcggggctggggcgggacggagcgggaaaggaagcctaggagtcgagggctttggggaggagtgggtctgagtcccagaggaaccctcaacctggacagagcgggcggcttctacctggtgaaaacttcagaggcccgggtcagtctggggggcgggtgtcagcggccccagtgacgcccccttgcccgcaggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447842 - DNA, 4269 bp, Homo sapiens
cagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447843 - DNA, 4602 bp, Homo sapiens
gcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447844 - DNA, 4798 bp, Homo sapiens
gcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgggcggggctggggcgggacggagcgggaaaggaagcctaggagtcgagggctttggggaggagtgggtctgagtcccagaggaaccctcaacctggacagagcgggcggcttctacctggtgaaaacttcagaggcccgggtcagtctggggggcgggtgtcagcggccccagtgacgcccccttgcccgcaggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447845 - DNA, 4365 bp, Homo sapiens
cagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggtgatggggacagctgggagtgggcccgggtgaggggctcatagcggggcgctggaggccggtggaggtcaccaccctgcccctgcctgctctcaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgatttacctggctga

SEQ ID NO: 447846 - DNA, 973 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacttggcctgttctcttccccggccgcttggcgtcgctgtccccctcccgtacac

SEQ ID NO: 447847 - DNA, 719 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaagggagaggtgcccaagtttcattgaacttacatcaccacacaagaggtggagaagaggacttataaatattgtttctatgacatttgaaaataaatgttttactccatgctaaa

SEQ ID NO: 447848 - DNA, 2178 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447849 - DNA, 2054 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447850 - DNA, 2250 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagctaaaagcgagatggaagaggaattaaaaaaatgtgtgtatttacatttatatttattattgtgccacttagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447851 - DNA, 1968 bp, Homo sapiens
gggctggtactggtccggagtgtagggatcaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447852 - DNA, 2126 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagctaaaagcgagatggaagaggaattaaaaaaatgtgtgtatttacatttatatttattattgtgccacttagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447853 - DNA, 1788 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447854 - DNA, 1172 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggctggtctccttcaactgtgatgggttggctgtacacttcaagtaatcaggatggtgtgagtcaagtgcaagatagtagagttaggaaaccgaattggctacaattacatagtgttcctaggggtgtaagtgagcccacggggtcttgccaggtccacagttttatggcatcactgttggggtgattcatcgcgtgggaaggttaggggggggctaaagttgttgagaacagtggaaggtgggggggcacatggtatgggcaacacatctcggaagggggcccagggtgtcaagctgtgtagggcggtgta

SEQ ID NO: 447855 - DNA, 2065 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447856 - DNA, 2109 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447857 - DNA, 1941 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447858 - DNA, 2134 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447859 - DNA, 2010 bp, Homo sapiens
  misc_feature (19)..(19): n is a, c, g, or t
agcatttaatcatgaggcnctccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447860 - DNA, 2019 bp, Homo sapiens
gcaccaggtaggaagcttcaccaccatctcctcagaatgagtcatggttggtctaagccaaaagtggaaattgacttcctcttggactgatactgctttgggggtagtcatatgatcaacttctgaacaacgagatgaaagaggaaagttgctggagactaccctgttaaaagacaacaaacggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447861 - DNA, 1607 bp, Homo sapiens
  misc_feature (1)..(1): n is a, c, g, or t
ngctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagaagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccc

SEQ ID NO: 447862 - DNA, 5088 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447863 - DNA, 5671 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactgagaagagggggtgccgtgcttgtccttctccccacgggcgggcgcagcgcgtgcaccacccccgtggtgttaagttaaaagggggcagcgggcccgctcaggcgggtgtatataagagagagagagaggggcggcttacacacaaaatagatctggcggcagaaggaggcgaataaaaaagttgctttcagaagtcctcatgatacttgggctgaagaagacaagaacatccttttcagaatgcggatgtagagataatatcaatcgaaggagccacaccaccctaagtagaaaattagtcagggtcctcagtccatattgagcagtaaaaatattcaatgattcagaagtcgttacggatctacaacagcaagcatgatgttacttcctgccgcggaagactgagactttgctgctcgagtatctataagacaaataatatcg

SEQ ID NO: 447864 - DNA, 3961 bp, Homo sapiens
tagtgctgttgtctcatgggcggggtggggggaagagaactttagtataggtagaaaaggaaaatgagaccagctgtgttctagattgtttttccctcattctcatagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447865 - DNA, 1971 bp, Homo sapiens
caaaccctcaccgtttcgctttgttctgcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447866 - DNA, 1927 bp, Homo sapiens
gcggccgctccaacatcagaatggtaactgttaccattctgatgttggagcggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447867 - DNA, 4165 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataataaatttagggttgatgtgaatcctctgaacagc

SEQ ID NO: 447868 - DNA, 3860 bp, Homo sapiens
  misc_feature (3831)..(3831): n is a, c, g, or t
  misc_feature (3833)..(3833): n is a, c, g, or t
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggaaaaaaaaaaacccccccnanaaagaaaaaaaggggggggcctcgtgc

SEQ ID NO: 447869 - DNA, 431 bp, Homo sapiens
cctcccttcccctttagaaataagtcacgttaagagtatttcttcacggctaacctttgctcttttctttcctccattctttcatgtcctctaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccgggtaagtttcctttctcttcatttacttggccaagttttttctagtagacatgctgttcttgaaggcaaagggagccctttttgctgtgagatgatgattcttctgctttagagggaatactgtgttctaattgcatcagcccgttgtgctgggaaaatcaagcttttgaaactttt

SEQ ID NO: 447870 - DNA, 5028 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447871 - DNA, 5034 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaatatatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447872 - DNA, 3708 bp, Homo sapiens
agaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattatagagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttcta

SEQ ID NO: 447873 - DNA, 2130 bp, Homo sapiens
caaggatgaggcggggtttcgccgtggcgcgcatgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447874 - DNA, 280 bp, Homo sapiens
ccccgactagcccgacagtccccgactagcccgacagccccccactagcccgacagtccccgactagcccgacagcccagccctgtgtgcccttggtcgcagcccccctcttcctcagggccagcgacagaccctgctcttcagtgccaccatgccgaagaagattcagaactttgctaagagtgcccttgtaaagcctgtgaccatcaatgtggggcgcgctggggctgccagcctggatgtcatccaggtgggcaggtgctcctgatgggcggtctct

SEQ ID NO: 447875 - DNA, 2265 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacagtgagtgctggcgctccctgccccccacctctgccacctgcgagtctgtggaaaagctaaaggaccctttaccttagccactccacagatcttcacagagggctgctgtgagtgcgaccctcaaggagctcccagtctaatggggagcggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447876 - DNA, 2251 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaaggtcagggtggtgcaagcactggcttggaccctgctgcagtagcagcgctttacctaatgccttcccctgctggttggcctgccactcccctatcccatggtggctctgacagtgtctgcctgaccctccccagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447877 - DNA, 2213 bp, Homo sapiens
caaggatgaggcggggtttcgccgtggcgcgcatgcgtgcagcaaagaatggaggagtcggaacccgaacggaaggtaggagagaggcgagaccccgcgcgtgtgggagcgggcgtgaagaggggagcaggccgtgcctgactggcgtgtgcttgcagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447878 - DNA, 1965 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggatggtcctggctgcctgttccctgtgctcttcagaattactgtttttgtttccttttaccccagctgccattaaagcccaaacctctagcca

SEQ ID NO: 447879 - DNA, 2490 bp, Homo sapiens
caaggatgaggcggggtttcgccgtggcgcgcatgcgtgcagcaaagaatggaggagtcggaacccgaacggaaggtaggagagaggcgagaccccgcgcgtgtgggagcgggcgtgaagaggggagcaggccgtgcctgactggcgtgtgcttgcagcgggctcgcaccgacgaggtgcctgccggaggaagccgctccgaggcggaagatgaggacgacgaggactacgtgccctatgtgccgttacggcagcgccggcagctactggtgaggggcacgcgtccggggagggatggggccgtgaccgcggggtcgcagggggcgggcgtggcctcggcctccgtggggaggagggcagtctgaggagtgagcttcagtacaccagggcgcggcccccagacaaacgagggaccgacggcttgatctgaggggtagggcagctttgcgcctcgggcacaggatcctcgccccaaagccaggatcctgacgctgaccttgtggactccatgcccatcctatctgtggatcccgggtggaacctcagctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447880 - DNA, 1691 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447881 - DNA, 1481 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggataacatcatgttatcgcccaacactagatatgaatccattaacactgacatacaattgaccagctgttatagagccattcttgtatccctgaaaggctgaaatgggggaaaagagagaaacagactggctagaatacacagctcctctagtggcattcctgttaaaacaacctcataggtcagagatgccactgatcagtcctagatttcagtaatatataatgacagtgtatcact

SEQ ID NO: 447882 - DNA, 1441 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447883 - DNA, 947 bp, Homo sapiens
caaggatgaggcggggtttcgccgtggcgcgcatgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggaggctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447884 - DNA, 331 bp, Homo sapiens
  misc_feature (21)..(21): n is a, c, g, or t
gcgtcgacggcagtcagtganccgatgacccaggcccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447885 - DNA, 255 bp, Homo sapiens
agtctgccaaggagaagcagctgaaggaagaagagaagatcctggagagtgttgccgagggccgaggtatggttgtagccaggatagtgagaaggtggactgagtcttctcctcccagccccaggcatgttatatctcaagggatctggcttctcagaagcaggagccagccctgagccatgtctctctcttcagcattgatgtcagtgaaggagatggctaagggcattacgtatgatgaccccatcaaaacca

SEQ ID NO: 447886 - DNA, 370 bp, Homo sapiens
ctctctctctctctctgagcctcagtttcatcatctgcaacttgtaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccatgtgagtgtggactgtggacctggggtccttgaggagggctggaacagggaggagcaatggctaggtgtccttcatcttctgttgaaattggccctcgggtcatcctctcccaacagtctatctggccgtgacatgataggcatcgctttcacgggttcaggcaagacac

SEQ ID NO: 447887 - DNA, 694 bp, Homo sapiens
ctgcagatgtgactgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447888 - DNA, 2118 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447889 - DNA, 2234 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacatgctgtgcagtcctctgcagaccaccagaggccctggaccaggccctctgttcacagatgggccagaccccatcccggaggccttcctccacggacttctgagtattagggagatgcggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447890 - DNA, 2534 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagccaaaaaaaaaaagaaaaaaaaagaaaaaaaaaaaaaaaaaaaaaagggggggggggggcaaagaggatccccggggggggccaaagtatgggggtaccagggtctctggtgggcaacaagggggccccataagggggacacgattctacacacgaagcacgggcgccgagataacaaaggctagaaggggaacaatggaaaggggaacactggggggagagaaccccaaaaaataggacggcgggggacacacaagcggggcgcacacaccacccagccggagaatataaagcgcgccaggagggacaataatgaacactgaggcgcgccagcaggggggctacacacacgacgacaagatactcgcgctgcggaagaaaatgcgccaggcgaaaatcaatgcgcaccacatatcgga

SEQ ID NO: 447891 - DNA, 1696 bp, Homo sapiens
ctgcacctagcctgtgggccttggacaagtctctttttttctttttttttttccactctctctctctctctctgagcctcagtttcatcatctgcaacttgtaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447892 - DNA, 1652 bp, Homo sapiens
ctgcacctagcctgtgggccttggacaagtctctttttttctttttttttttccactctctctctctctctctgagcctcagtttcatcatctgcaacttgtaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccatgcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagcca

SEQ ID NO: 447893 - DNA, 775 bp, Homo sapiens
  misc_feature (29)..(29): n is a, c, g, or t
  misc_feature (31)..(32): n is a, c, g, or t
ggtcgactactactaaattcgcggccgcntnnacgaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccaggtatgtctgtacagtctgcagttgcccttgcttaggatggtacatgcagggatgctcccaggccagctattcccagggctctcttgatccctgttacccatccacagctggactccaccccgttatgttctgagcatgtctgaagagcgacatgagcgcgtgcggaagaaataccacatcctggtggagggagacggtatcccaccacccatcaagagcttcaaggaaatgaagtttcctgcaggtagtcaggggctggagagagataccaaattttataatcaaatgcctgtgaggttatgtcc

SEQ ID NO: 447894 - DNA, 3834 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttct

SEQ ID NO: 447895 - DNA, 785 bp, Homo sapiens
gtagagactgggtctcactgtattgcccaaactggttttgaactcttgggcacaagcagtctgcccaccttggcctcctaaagtgctaggatttcaggcgtgagctactgtgcccaatcctgatttccttttaattcaaacagaaatgggagactaagtttagtttgccacttacaggatctagctggtaatacagtttccagagatcatttattttcaaaaacttctggattcgttaataaagttttattgagtgattattacatgcaaagcacaagtctgcaaaacagttcctttgaatgcttttcccctagggtggtaaattaataaacattaagtacttattttataccagttattgattcctgtccttcccttggcattttctcttggcagcctcccgagcacaacaaggagaggtgatgaggttggcatgtcgtttggatcccaaaactagcttccagatggctggggagtggctaaagtatcaactatcaacttttcttgatgctggttctgtgaattgtaagtttttttcattactgaatgttagtgaaatgttaggacagtatcaaaactatatataggaaatgagcctgagctatacacacatcagaacgatatacttatactattcaaaaatagctttgctcatcctggagagggagcgttttcattggctgacacaaagaaagcagatgacacattttaaatttgttttaaattagggtaaaaccatgtccttatcagttttgccatcattttccatttctaacagaatcaac
